US009944908B2

(12) United States Patent
Vatèn et al.

(10) Patent No.: US 9,944,908 B2
(45) Date of Patent: Apr. 17, 2018

(54) POLYPEPTIDE

(71) Applicant: HELSINGIN YLIOPISTO, Helsingin yliopisto (FI)

(72) Inventors: Anne Vatèn, Helsinki (FI); Jan Dettmer, Erlangen (DE); Shunsuke Miyashima, Helsinki (FI); Shri Ram Yadav, Helsinki (FI); Ana Campilho, Porto (PT); Vincent Bulone, Täby (SE); Raffael Lichtenberger, Helsinki (FI); Satu Lehesranta, Espoo (FI); Ari Pekka Mähönen, Helsinki (FI); Annelie Carlsbecker, Uppsala (SE); Yrjö Helariutta, Helsinki (FI); Kaori Furuta, Helsinki (FI)

(73) Assignee: HELSINGIN YLIOPISTO, Helsingin yliopisto (FI)

( * ) Notice: Subject to any disclaimer, the term of this patent is extended or adjusted under 35 U.S.C. 154(b) by 749 days.

(21) Appl. No.: 14/410,941

(22) PCT Filed: Nov. 29, 2012

(86) PCT No.: PCT/FI2012/051180
§ 371 (c)(1),
(2) Date: Feb. 5, 2015

(87) PCT Pub. No.: WO2013/079796
PCT Pub. Date: Jun. 6, 2013

(65) Prior Publication Data
US 2016/0002659 A1   Jan. 7, 2016

(30) Foreign Application Priority Data

Dec. 1, 2011   (FI) ...................................... 20116212

(51) Int. Cl.
*A01H 5/10* (2006.01)
*C12N 15/82* (2006.01)
*C12N 15/54* (2006.01)
*C12N 9/10* (2006.01)
*A61K 9/00* (2006.01)

(52) U.S. Cl.
CPC .......... *C12N 9/1051* (2013.01); *A61K 9/0075* (2013.01); *C12N 15/8246* (2013.01); *C12N 15/8261* (2013.01); *C12N 15/8271* (2013.01); C12Y 204/01034 (2013.01)

(58) Field of Classification Search
CPC ............................ C12N 9/1074; C12N 9/1048
See application file for complete search history.

(56) References Cited

U.S. PATENT DOCUMENTS 5,352,605 A  10/1994  Fraley
5,447,858 A   9/1995  Key
5,464,758 A  11/1995  Gossen
5,512,483 A   4/1996  Mader
5,641,876 A   6/1997  McElroy
5,750,385 A   5/1998  Shewmaker
6,072,050 A   6/2000  Bowen
6,410,828 B1  6/2002  Armstrong
6,566,586 B1  5/2003  Stalker
6,784,340 B1  8/2004  Aoyama
2001/0047525 A1  11/2001  Wesley

FOREIGN PATENT DOCUMENTS

| AU | 765413 | 9/2003 | |
| EP | 0637339 B1 | 2/1995 | |
| WO | 2008/079545 A2 | 7/2008 | |
| WO | WO 2010/087805 | * 8/2010 | |
| WO | WO 2010/087805 A2 | 8/2010 | |
| WO | WO 2010087805 A2 | * 8/2010 | ........... C12N 9/1051 |
| WO | WO 2013/079796 | 6/2013 | |

OTHER PUBLICATIONS

Jacobs et al (The Plant Cell, vol. 15, 2503-2513, Nov. 2003).*
Dong et al (The Plant Journal (2005) 42, 315-328).*
Uniprot Accession Q9ZT82 (2001).*
GenBank Accession AAM15250.1, available online as early as Apr. 18, 2002.*
NCBI Reference Accession: NP_001184913.1.*
EPO office action dated Sep. 11, 2015 of European Application No. 12 806 067.0-140.
Carlsbecker et al. Cell Signaling by MicroRNA165/6 Directs Gene Dose-Dependent Root Cell Fate. Nature. 465:316-321 (2010).
Chen et al. Callose Synthesis in High Plants. Plant Signaling & Behavior 4:6 489-492 (2009).
Clough et al. Floral Dip: A Simplified Method for Agrobacterium-mediated Transformation of *Arabidopsis thaliana*. The Plant Journal. 16(6):735-743 (1998).
Database Uniprot, Accession No. Q9S9U0. Callose synthase 11 [retrieved Sep. 6, 2012] & The *Arabidopsis* Information Resource, nucleotide sequence AT4G04970.1, Nov. 5, 2005 & alignment with SEQ ID No. 1 [retrieved from EBI Sep. 17, 2012] (the residue corresponding to P189 of SEQ ID No. 1 is V) (2008).
Database Uniprot, Accession No. E9KSP0. Callose synthase 7 & alignment with SEQ ID No. 1 [retrieved from EBI Sep. 6, 2012] (the residue corresponding to P189 of SEQ ID No. 1 is H) (2011).
Database Uniprot, Accession No. F0W7D8. Callose Synthase Putative & Alignment With SEQ ID No. 1 [retrieved from EBI Sep. 7, 2012] the residue corresponding to R1926 of SEQ ID No. 1 is K) (2011).

(Continued)

*Primary Examiner* — Lee A Visone
(74) *Attorney, Agent, or Firm* — Banner & Witcoff, Ltd.

(57) ABSTRACT

The present invention relates to a polypeptide, or a fragment thereof, capable of enhancing callose biosynthesis and/or accumulation, wherein at least one of the conserved amino acid residues selected from the group consisting of residue corresponding to R84 of SEQ ID NO: 1, residue corresponding to R1926 or SEQ ID NO: 1 and residue corresponding to P189 of SEQ ID NO: 1, of the polypeptide or a fragment thereof, is modified by a mutation selected from the group consisting of substitution and deletion.

15 Claims, 8 Drawing Sheets

(56) References Cited

OTHER PUBLICATIONS

Database Uniprot, Accession No. D7FXN7. 1, 3-beta-glucan synthase, family GT48 & alignment with SEQ ID No. 1 [retrieved from EBI Sep. 7, 2012] (the residue corresponding to P189 of SEQ ID No. 1 is M and the residue corresponding to R1926 of SEQ ID No. 1 is A) (2010).
Database Uniprot, Accession No. Q9ZT82. Powdery Mildew Resistant 4. XP-002693873 (1999).
Database Uniprot, Accession No. D0MXP3. Genome sequence and analysis of the Irish potato famine pathogen *Phytophthora infestans*. XP-002693874 (2009).
Database Uniprot, Accession No. B9SQ54. Draft genome sequence of the oilseed species *Ricinus COITillUnis*. XP-002693875 (2009).
Database Uniprot, Accession No. Q9SHJ3. Glucan Synthase-like 7. XP-002693876 (2008).
FI Search Report dated Sep. 25, 2012.
Hellens et al. pGreen: A Versatile and Flexible Binary Ti Vector for Agrobacterium-mediated Plant Transformation. Plant Molecular Biology 42: 819-832 (2000).
Him et al. Biosynthesis of (1→3)-β-D-glucan (callose) by detergent extracts of a microsomal fraction from *Arabidopsis thaliana*. Eur. J. Biochem. 268: 4628-4638 (2001).
Hong et al. A cell plate-specific callose synthase and its interaction with phragmoplastin. The Plant Cell. 13(4): 755-68 (2001).
http://www.ebi.ac.uk/Tools/msa/kalign/.
Imlau et al. Cell-to-cell and long-distance trafficking of the green fluorescent protein in the phloem and symplastic unloading of the protein into sink tissues. The Plant Cell. 11: 309-322 (1999).
Ingram et al. *Arabidopsis* Lateral Root Development 3 is Essential for Early Phloem Development and Function, and Hence for Normal Root System Development. The Plant Journal 38: 455-67 (2011).
Lassman et al. Kalign—An Accurate and Fast Multiple Sequence Alignment Algorithm. BMC Bioinformatics 6:298 (2005).
Lipman et al. Rapid and Sensitive Protein Similarity Searches. Science 227: 1435-1441 (1985).
Love et al. Ethylene is an Endogenous Stimulator of Cell Division in the Cambial Meristem of Populus. Proc. Natl. Acad. Sci. USA. 106(14): 5984-89 (2009).
Maltby, et al. β-1,3-Glucan in Developing Cotton Fibers. Plant Physiol. 63: 1158-64 (1979).
Nieminen et al. Cytokinin Signaling Regulates Cambial Development in Poplar. PNAS. 105: 20032-37 (2008).
Paciorek et al. Immunocytochemical Technique for Protein Localization in Sections of Plant Tissues. Nature Protocols 104(1): 104-107 (2006).
Peña et al. *Arabidopsis* Irregular Xylem8 and Irregular Xylem9; Implications for the Complexity of Glucuronoxylan Biosynthesis. The Plant Cell. 19: 549-563 (2007).
Pyo et al. Spatial and Temporal Tracing of Vessel Differentiation in Young *Arabidopsis* Seedlings by the Expression of an Immature Tracheary Element-specific Promoter. Plant Cell Physiol. 45(10): 1529-1536 (2004).
Pyo et al. TERE; a novel cis-element responsible for a coordinated expression of genes related to programmed cell death and secondary wall formation during differentiation of tracheary elements. The Plant Journal 51: 955-965 (2007).
Simpson et al. An *Arabidopsis* GPI-Anchor Plasmodesmal Neck Protein with Callose Binding Activity and Potential to Regulate Cell-to-Cell Trafficking. The Plant Cell. 21: 581-594 (2009).
Sivaguru et al. Aluminum-Induced 1→3β-R-D-Glucan Inhibits Cell-to-Cell Trafficking of Molecules through Plasmodesmata. A New Mechanism of Aluminum Toxicity in Plants. Plant Physiology. 124: 991-1005 (2000).
Taylor et al. The Irregular Xylem3 Locus of *Arabidopsis* Encodes a Cellulose Synthase Required for Secondary Cell Wall Synthesis. The Plant Cell. 11:769-779 (1999).
Turner et al. Collapsed Xylem Phenotype of *Arabidopsis* Identifies Mutants Deficient in Cellulose Deposition in the Secondary Cell Wall. The Plant Cell. 9:689-701 (1997).
Vatén et al. Callose Biosynthesis Regulates Symplastic Trafficking During Root Development. Development Cell 21:1144-1155 (2011).
Xu et al. Lights at the end of the tunnel: new views of plasmodesmal structure and function. Plant Biology 13:684-692 (2010).
Zavalievet et al. Biology of callose (I-1,3-glucan) turnover at plasmodesmata. Protoplasma. 248:117-130 (2010).

\* cited by examiner

Figure 1A (sequence alignment figure — unreadable at this resolution)

WT C24
+ gcals3m

POLYPEPTIDE

FIELD OF THE INVENTION

The invention relates to improved polypeptides for enhancing callose biosynthesis and accumulation.

BACKGROUND OF THE INVENTION

Callose is a plant polysaccharide composed of glucose residues linked together through β-1,3-linkages, and is termed a β-glucan (β-1,3-glucan). It is thought to be manufactured at the cell wall by callose synthases (Chen and Kim, Plant Signaling & Behavior 2009, 4(6), 489-492). It is laid down e.g. at plasmodesmata, at the cell plate during cytokinesis and during pollen development. Callose plays many important roles in plants and is produced in response to e.g. wounding, infection by pathogens, aluminium and abscisic acid. Furthermore, callose deposition has been shown to affect cell-to-cell signalling, and impaired trafficking between cells has been shown to result from increased callose accumulation at the plasmodesmata (Sivaguru et al., Plant Physiology 2000, 124(3), 991-1006; Simpson et al., Plant Cell 2009, 21, 581-594). Callose polymer has chemical and physical properties distinct from the related cellulose polymer, a β-1,4-glucan (Maltby et al., Plant Physiology 197, 1158-1164).

Currently, however, callose biosynthesis is poorly characterized, and efficient tools for enhancing callose biosynthesis and accumulation have not been available. WO2010/087805 has previously described the overexpression of wild-type callose synthase. The overexpression of wild-type callose synthases appears, however, to result only in limited increases in callose biosynthesis and/or accumulation.

PURPOSE OF THE INVENTION

The purpose of the present invention is to disclose novel polypeptides that enhance callose biosynthesis and/or accumulation, polynucleotides encoding said polypeptides, expression cassettes and vectors comprising said polynucleotides, host cells and transgenic plants comprising said polynucleotides and their uses.

SUMMARY

The present invention relates to a polypeptide, or a fragment thereof, capable of enhancing callose biosynthesis and/or accumulation, wherein at least one of the conserved amino acid residues selected from the group consisting of residue corresponding to R84 of SEQ ID NO: 1, residue corresponding to R1926 of SEQ ID NO: 1 and residue corresponding to P189 of SEQ ID NO: 1, of the polypeptide, or a fragment thereof, is modified by a mutation selected from the group consisting of substitution and deletion.

In one embodiment, the mutation is a substitution selected from the group consisting of the substitution of R to K and the substitution of P to L.

In one embodiment, the polypeptide comprises a sequence having at least 95%, preferably at least 99%, sequence identity to a sequence selected from the group consisting of SEQ ID NO:s 1-48, or is a fragment thereof.

In one embodiment, the polypeptide comprises a sequence having at least 95%, preferably at least 99%, sequence identity to a sequence selected from the group consisting of SEQ ID NO:s 1-5, 8, 10, 12-31, 33-40, 42 and 44-47, or is a fragment thereof.

In one embodiment, the polypeptide or a fragment thereof comprises a sequence that is at least 95% identical to a sequence selected from the group SEQ ID NO:s 49-55.

In one embodiment, the polypeptide or a fragment thereof comprises a sequence that is at least 99% identical to a sequence selected from the group SEQ ID NO:s 49-55.

In one embodiment, the polypeptide or a fragment thereof comprises a sequence selected from the group consisting of SEQ ID NO:s 49-55.

In one embodiment, the polypeptide or a fragment thereof enhances callose biosynthesis and/or accumulation in a host cell.

The present invention also relates to a polynucleotide encoding the polypeptide of the present invention or a fragment thereof.

The present invention also relates to an expression cassette comprising the polynucleotide of the present invention.

In one embodiment, the expression cassette comprises a tissue-specific or an inducible promoter operably linked to said polynucleotide.

The present invention also relates to a vector comprising the polynucleotide or the expression cassette of the present invention.

The present invention also relates to a host cell comprising the polynucleotide, the expression cassette or the vector of the present invention.

In one embodiment, the host cell is a prokaryotic cell.
In one embodiment, the host cell is a microbial cell.
In one embodiment, the host cell is a plant cell.

The present invention also relates to a plant comprising the polynucleotide or the expression cassette of the present invention.

The present invention also relates to a transgenic plant stably transformed with the vector of the present invention.

The present invention also relates to the use of the polypeptide, the polynucleotide, the expression cassette or the vector of the present invention for modifying composition of the plant cell wall.

The present invention also relates to a method for modifying the composition of the plant cell wall, comprising the step of introducing to a cell of the plant the polynucleotide, the expression cassette, or the vector of the present invention.

The present invention also relates to the use of the polypeptide, the polynucleotide, the expression cassette or the vector for regulating closure of plasmodesmata.

The present invention also relates to a method for regulating closure of plasmodesmata, comprising the step of introducing to a cell of the plant the polynucleotide, the expression cassette, or the vector of the present invention.

The present invention also relates to the use of the polypeptide, the polynucleotide, the expression cassette or the vector for producing a plant resistant to pathogen.

The present invention also relates to a method for producing a plant resistant to pathogen, comprising the step of introducing to a cell of the plant the polynucleotide, the expression cassette, or the vector of the present invention.

The present invention also relates to the use of the polypeptide, the polynucleotide, the expression cassette or the vector for modifying wood formation and/or wood composition.

The present invention also relates to a method for modifying wood formation and/or wood composition, comprising the step of introducing to a cell of the plant the polynucleotide, the expression cassette, or the vector of the present invention.

The present inventors have identified mutations that enhance callose biosynthesis and/or accumulation in plant cell walls, especially around the plasmodesmata, the channels through which the two neighbouring cells communicate. This enhancement leads to dramatic callose accumulation. Furthermore, the increased callose biosynthesis can lead to closure of plasmodesmata and inhibition of cell-to-cell signalling. Therefore use of a polypeptide comprising these mutations can also be applied to modification of any plant characteristic which is regulated by signals moving via plasmodesmata, for example plant architecture, flowering and virus resistance just to mention a few. These are all aspects which can be applied to achieve enhanced quality and quantity of crops. Furthermore, cellulose is a main source of raw material and energy. Since cellulose synthases and callose synthases share the same substrate, UDP-glucose, synthesis of another is likely to affect synthesis of other. Hence regulation of callose synthesis may provide means to modify composition of the cell wall, e.g. to make it more easily degradable. It is also known that accumulation of callose improves the resistance of a plant cell to an insult such as pathogen attack. Thus regulation of callose synthesis may allow for producing a plant greatly more resistant to pathogens.

Thus, the present invention has several advantages: because it provides greatly improved callose biosynthesis and/or accumulation, it can be used e.g. to produce plant material comprising callose in greater quantities for further refining or use in the industry; to produce plants having a modified composition of the cell wall and thus providing e.g. more easily degradable plant material for processing or energy production; to produce plants that are more resistant to pathogens for use in e.g. agriculture; and to affect plant signalling to obtain desirable characteristics, e.g. to facilitate elongation of cotton fibers and subsequently produce improved fiber material.

BRIEF DESCRIPTION OF THE DRAWINGS

The accompanying drawings, which are included to provide a further understanding of the invention and constitute a part of this specification, illustrate embodiments of the invention and together with the description help to explain the principles of the invention. In the drawings:

FIG. 1A shows a partial alignment of callose synthase sequences including the conserved amino acid residue corresponding to R84 of SEQ ID NO: 1.

FIG. 1B shows a partial alignment of callose synthase sequences including the conserved amino acid residue corresponding to P189 of SEQ ID NO: 1.

FIG. 1C shows a partial alignment of callose synthase sequences including the conserved amino acid residue corresponding to R1926 of SEQ ID NO: 1.

DETAILED DESCRIPTION OF THE INVENTION

Figure 2:
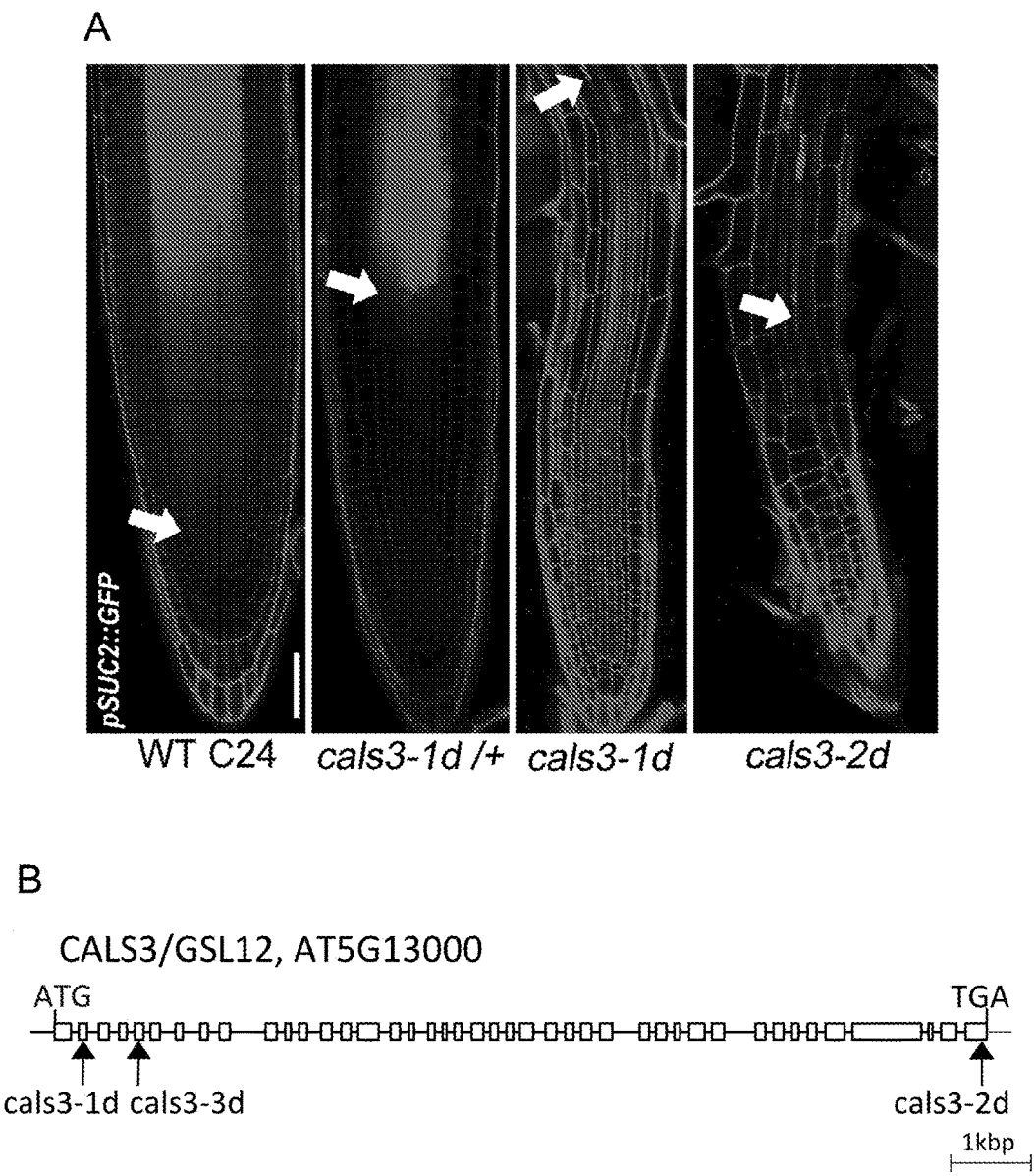
FIG. 2A shows the seedling phenotype of wild-type plants (first panel) and plants comprising heterozygous (second panel) and homozygous (third and fourth panel) mutations of CalS3.
FIG. 2B shows a schematic view of the intron-exon structure of the gene encoding CalS3 and sites of the mutations.

Reference will now be made in detail to the embodiments of the present invention, examples of which are illustrated in the accompanying figures.

The present inventors have surprisingly found that mutations in certain conserved key amino acid residues in polypeptides annotated as callose synthase (CalS) proteins may lead to dramatic enhancement in callose biosynthesis and/or accumulation.

The present invention relates to a polypeptide that comprises a callose synthase or a fragment thereof.

In this context, the term "polypeptide capable of enhancing callose biosynthesis and/or accumulation" or "callose synthase" or "CalS" should be understood as referring to any polypeptide of plant origin that enhances callose biosynthesis and accumulation in a plant cell, wherein said polypeptide comprises a sequence at least 90% identical to any one of the sequences set forth in SEQ ID NO:s 1-48 and comprises at least one conserved amino acid residue selected from the group consisting of residue corresponding to R84 of SEQ ID NO: 1, residue corresponding to R1926 of SEQ ID NO: 1 and residue corresponding P189 of SEQ ID NO: 1, which may, according to the present invention, be modified by a mutation. To determine the extent of identity of two sequences, methods of alignment are well known in the art. Thus, the determination of percent identity between any two sequences can be accomplished using a mathematical algorithm such as the algorithm described by Lipman and Pearson (Science 1985, 227(4693), 1435-1441). The sequences set forth in SEQ ID NO:s 1-48 are provided as examples; the present invention should be understood as not limited to polypeptides obtained based on these sequences only. A person skilled in the art will appreciate that other sequences, e.g. paralogs or orthologs, encoding callose synthases comprising the same conserved amino acid residues which may be mutated and providing the same activity or functionality may be found in other species or genetic backgrounds or produced artificially; these sequences may be considered substantially similar, i.e. representing functional and structural equivalents.

Figure 1C:
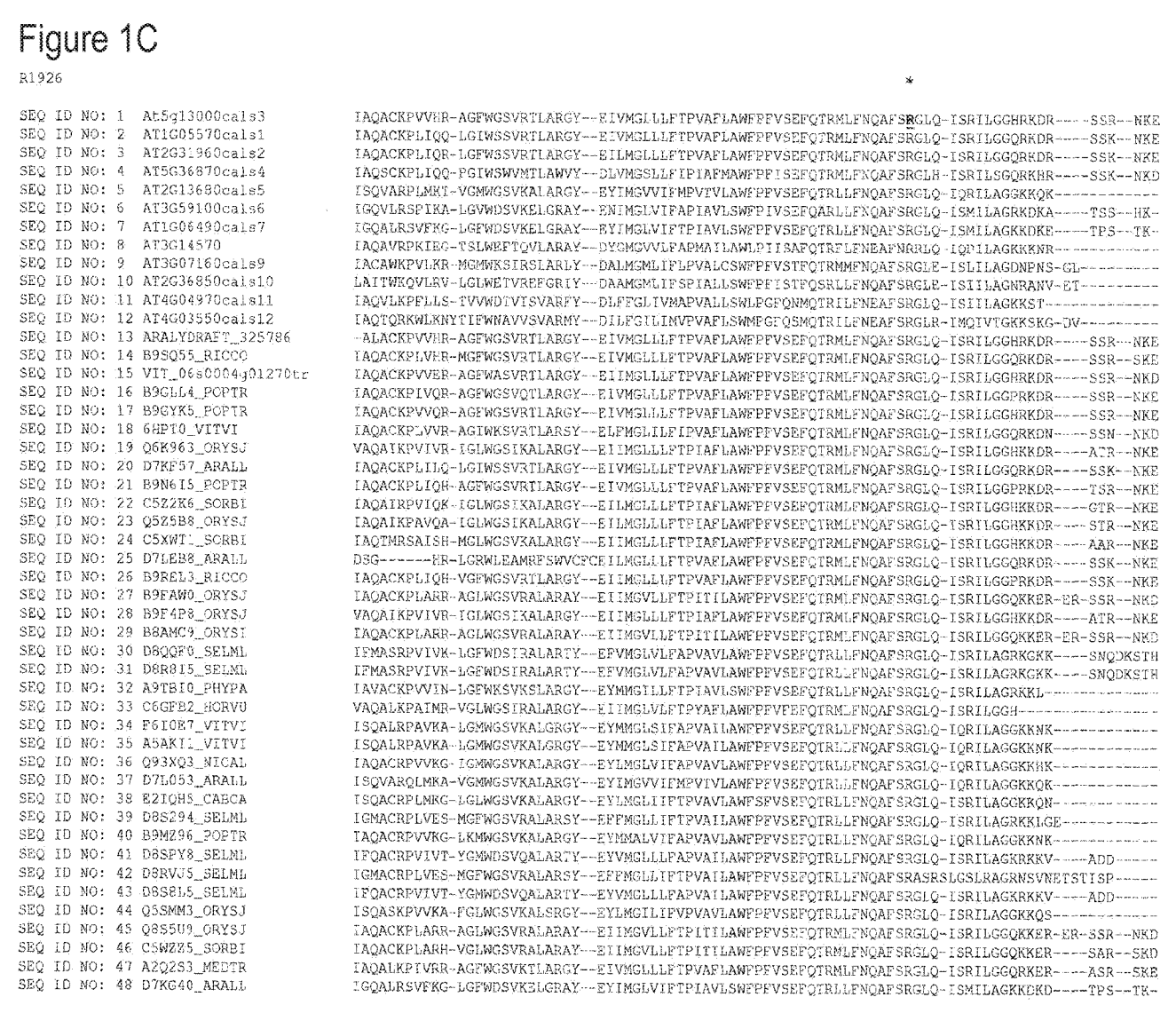

In this context, the term "conserved amino acid residue" should be understood as referring to an identical amino acid residue present in an analogous part of a polypeptide sequence, e.g. a paralogous or an orthologous sequence. In other words, said conserved amino acid residue may be an R (arginine) corresponding to R84 of SEQ ID NO: 1, R corresponding to R1926 of SEQ ID NO: 1 or P (proline) corresponding to P189 of SEQ ID NO: 1. FIG. 1 shows portions of the alignments of sequences set forth in SEQ ID NO:s 1-48 aligned using the Kalign software provided on the European Bioinformatics Institute website (www.ebi.ac.uk/Tools/msa/kalign/; Lassmann and Sonnhammer, BMC Bioinformatics 2005, 6, 298) using standard parameters (gap open penalty=11, gap extension penalty=0.85, terminal gap penalties=0.45, bonus score=0). The alignment shows the conserved amino acid residues marked with asterisks; the conserved regions surrounding them are easily identifiable by a person skilled in the art. For instance, the conserved amino acid residue corresponding to R84 of SEQ ID NO: 1 is typically included in the consensus sequence LDPTSS-GRGVRQFKT (amino acids 77-91 of SEQ ID NO: 1) (FIG. 1A); the conserved amino acid residue corresponding to R1926 of SEQ ID NO: 1 is typically included in the consensus sequence WFPFVSEFQTRMLFNQAFSRGLQ-ISRILGG (amino acids 1907-1936 of SEQ ID NO:1) (FIG. 1C); and the conserved amino acid residue corresponding to P189 is typically included in the consensus sequence YVPY-NILPLDPDS (amino acids 187-199 of SEQ ID NO:1) (FIG. 1B). As is evident to a person skilled in the art, the number of amino acid residues in the sequences of callose synthases varies, as does the exact position of the conserved amino acid residues; however, the conserved amino acid residues correspond to, i.e. align with, the residues R84, R1926 and P189 in the sequence set forth in SEQ ID NO: 1 (marked with asterisks in FIG. 1).

Thus the present invention relates to a polypeptide that comprises a callose synthase or a fragment thereof, as defined above, wherein at least one of the conserved amino acid residues selected from the group consisting of residue corresponding to R84 of SEQ ID NO: 1, residue corresponding to R1926 of SEQ ID NO: 1 and residue corresponding to P189 of SEQ ID NO: 1, of the polypeptide, or a fragment thereof, is modified by a mutation selected from the group consisting of substitution and deletion.

In one embodiment of the present invention, the term "polypeptide capable of enhancing callose biosynthesis and/or accumulation" or "callose synthase" or "CalS" should be understood as referring to a polypeptide comprising a sequence at least 95% identical to any one of the sequences set forth in SEQ ID NO:s 1-48, wherein the sequence comprises at least one conserved amino acid residue selected from the group consisting of R corresponding to R84 of SEQ ID NO: 1, R corresponding to R1926 of SEQ ID NO: 1 and P189 of SEQ ID NO: 1, which may, according to the present invention, be modified by a mutation.

In one embodiment of the present invention, the term "polypeptide capable of enhancing callose biosynthesis and/or accumulation" or "callose synthase" or "CalS" should be understood as referring to a polypeptide comprising a sequence at least 99% identical to any one of the sequences set forth in SEQ ID NO:s 1-48, wherein the sequence comprises at least one conserved amino acid residue selected from the group consisting of R corresponding to R84 of SEQ ID NO: 1, R corresponding to R1926 of SEQ ID NO: 1 and P189 of SEQ ID NO: 1, which may, according to the present invention, be modified by a mutation.

In one embodiment, the mutation(s) are artificially induced. The mutations may be introduced by artificial means using standard techniques known in the art, for instance by polymerase chain reaction-based site-directed mutagenesis.

In one embodiment of the present invention, the polypeptide of the present invention or a fragment thereof comprises a sequence that is at least 95% identical to a sequence selected from the group SEQ ID NO:s 49-55.

In one embodiment of the present invention, the polypeptide of the present invention or a fragment thereof comprises a sequence that is at least 99% identical to a sequence selected from the group SEQ ID NO:s 49-55.

In one embodiment of the present invention, the polypeptide of the present invention or a fragment thereof comprises a sequence selected from the group SEQ ID NO:s 49-55.

In one embodiment of the present invention, the polypeptide comprises a sequence selected from the group SEQ ID NO:s 52-55. This embodiment and other embodiments wherein two or more of the conserved amino acid residues are mutated have the added utility that the mutations appear to be additive to some extent, i.e. two or more mutations provide a stronger effect than one mutation alone.

In one embodiment of the present invention, the polypeptide of the present invention further comprises a signal peptide sequence that directs the transport or localization of the polypeptide to a specific part of the cell. The polypeptide may also comprise other sequences that convey desired characteristics, such as detection-enabling sequences or tags according to techniques well known in the art.

The term "fragment" as used herein should be understood as referring to a polypeptide comprising at least one part of the polypeptide of the present invention, provided that said polypeptide retains the activity of the polypeptide of the present invention, i.e. enhances callose biosynthesis and/or accumulation in a host cell.

A person skilled in the art may measure the functionality or activity of the polypeptide of the present invention or a fragment thereof using several different methods known in the art, for instance in vivo using a callose synthase assay performed as optimized by Him et al. (European Journal of Biochemistry 2001, 268, 4628-4638), or e.g. by staining plant tissues expressing the polypeptide of the present invention with aniline blue as demonstrated in Example 2.

The present invention also relates to a polynucleotide encoding the polypeptide of the present invention or a fragment thereof. A person skilled in the art will recognize that due to the degeneracy of the genetic code, a large number of functionally identical nucleic acids encode the polypeptides of the present invention and may be e.g. optimized for enhanced expression in a host cell of interest.

The present invention also relates to an expression cassette comprising the polynucleotide of the present invention that can be used to express the polypeptide of the present invention in a suitable host cell or organism. As used herein, the term "expression cassette" should be understood as referring to a polynucleotide produced by recombinant DNA techniques which comprises, in addition to the polynucleotide of the present invention, one or more sequences that are sufficient to drive the expression of the polypeptide of the present invention in a suitable host cell or organism, such as a promoter sequence.

In this context, the term "promoter" should be understood as referring to any DNA which is recognized and bound (directly or indirectly) by a DNA-dependent RNA-polymerase during initiation of transcription. A promoter includes the transcription initiation site, and binding sites for transcription initiation factors and RNA polymerase, and can comprise various other sites (e.g., enhancers), at which gene expression regulatory proteins may bind.

In one embodiment of the present invention, the expression cassette comprises a promoter suitable for driving the expression of the polypeptide. In one embodiment, the promoter may be ubiquitously expressed, or expressed broadly in a number of tissues and cell types. Examples of such promoters with broad general expression are e.g. promoters originally isolated from plant pathogens, such as CaMV 35S (described in e.g. U.S. Pat. No. 5,352,605), broadly expressed promoters isolated from plants such as the rice actin promoter (described in e.g. U.S. Pat. No. 5,641,876) and synthetic promoters such as those described in U.S. Pat. No. 6,072,050.

In one embodiment, the promoter may drive expression specifically in one or more specific tissues or cell types. This embodiment may have the added utility that the polypeptide of the present invention may be expressed only in cells or tissues of interest and thus provide improved expression levels and minimal side effects due to expression in unwanted tissues. Examples of promoters with spatial expression specificity are root specific promoters (e.g. US 2001/047525) and the cotton expansin promoter expressed in developing fiber (U.S. Pat. No. 6,566,586). In one embodiment, the promoter may drive expression specifically in vascular tissues such as developing xylem cells and cells and tissues associated with xylem; examples of such promoters are ZCP4 (Pyo et al., Plant Journal 2005, 51, 955-965)), LMX5 (Love et al., Proc Natl Acad Sci USA 2009, 106(14), 5984-5989) and BHK4 (Nieminen et al., Proc Natl Acad Sci USA 2008, 105(50), 20032-20037), the latter of which may be used in trees in particular.

In one embodiment, the promoter may be constitutive, such as e.g. the promoters CaMV35S and the rice actin promoter mentioned above.

In one embodiment, the promoter may be inducible. Examples of such inducible promoters are e.g. chemically regulated promoters such as alcohol-regulated (EP 0637339), tetracycline-regulated (U.S. Pat. No. 5,464,758), steroid-regulated (U.S. Pat. No. 5,512,483, U.S. Pat. No. 6,784,340) and metal-regulated promoters (U.S. Pat. No. 6,410,828), and physically regulated promoters such as temperature-regulated (U.S. Pat. No. 5,447,858) and light-regulated (U.S. Pat. No. 5,750,385, AU 765413) promoters.

In one embodiment, the expression cassette of the present invention further comprises other sequences that may e.g. have regulatory or stabilising functions. Various such sequences are known in the art, such as transcription termination sequences.

In this context, the term "vector" should be understood to refer to a polynucleotide produced by recombinant DNA techniques for delivering genetic material into a cell. As is well known in the art, it may refer to a plasmid, a cosmid, an artificial chromosome, a cloning vector, an expression vector or e.g. a binary vector suitable for transforming into a plant cell or a plant.

The present invention also relates to a host cell comprising or expressing the polypeptide, polynucleotide, expression cassette or vector of the present invention.

In one embodiment, the host cell is a prokaryotic cell. Examples of prokaryotic cells that may be used as a host cell are bacteria, such as eubacteria, cyanobacteria and prochlorophytes; and other micro-organisms such as Rickettsia, Mycoplasma, Spiroplasma and Chlamydia.

In one embodiment, the host cell is a microbial cell. Examples of microbial cells are prokaryotic cells mentioned above, yeasts, fungi, archaea and protists; microscopic plant cells, e.g. green algae; and protozoa.

In one embodiment, the host cell is a eukaryotic cell. Examples of eukaryotic cells that may be used as a host cell are e.g. yeast, fungal, plant and animal cells or protoplasts and cell lines derived thereof.

In one embodiment, the host cell is a plant cell. The class of plants which can be used to produce the plants or plant cells of the present invention is generally as broad as the class of higher plants amenable to transformation techniques, including both monocotyledonous and dicotyledonous plants, examples of which are e.g. Populus, cotton, maize, rice and conifer trees only to mention a few.

Wherever the expression cassette and the vector the invention are directed to introduction of the polynucleotide of the present invention in a plant cell, it will be clear that such methods can also be applied in cases whereby the plant cell is incorporated into a mature plant. E.g. transgenic cells may be regenerated into transgenic plants according to established methods. Any methods to transform plant cells and plants of different species and genetic backgrounds known in the art may be used, including e.g. Agrobacterium mediated transformation or particle bombardment (biolistics).

In this context, the term "stably transformed" should be understood as referring to a plant that has incorporated the polynucleotide of the present invention in its genetic material in a manner that may be inherited. The obtained transgenic, i.e. transformed, plant can be used in a conventional breeding scheme to produce more transgenic plants with the same characteristics or to introduce the polynucleotide or expression cassette according to the invention in other varieties of the same or related plant species, or in hybrid plants. In one embodiment, seeds obtained from the transformed plants that contain the polynucleotide or expression cassette of the present invention as a stable genomic insert are also encompassed by the invention.

In this context, the term "pathogen" should be understood as referring to a microorganism that causes disease in plants. The class of pathogens may be e.g. a fungus, nematode or oomycete but may be as broad as the class of pathogens that can invade any species of higher plants that may be used to produce the plant of the present invention.

The embodiments of the invention described hereinbefore may be used in any combination with each other. Several of the embodiments may be combined together to form a further embodiment of the invention. A product, or a use, or a method to which the invention is related, may comprise at least one of the embodiments of the invention described hereinbefore.

EXAMPLES

In the following, the present invention will be described in more detail. Reference will now be made in detail to the embodiments of the present invention, examples of which are illustrated in the accompanying drawings. The description below discloses some embodiments of the invention in such detail that a person skilled in the art is able to utilize the invention based on the disclosure. Not all steps of the embodiments are discussed in detail, as many of the steps will be obvious for the person skilled in the art based on this specification.

Unless stated otherwise in the Examples, all recombinant DNA techniques are carried out according to standard protocols as described e.g. in Sambrook et al. (1989) Molecular Cloning: A Laboratory Manual, Second Edition, Cold Spring Harbor Laboratory Press, NY and in Volumes 1 and 2 of Ausubel et al. (1994) Current Protocols in Molecular Biology, Current Protocols, USA.

Example 1. Screening of Mutations in the Gene Encoding CALS3

Two independent genetic screens based on EMS mutagenesis were performed to identify mutations of the present invention as described in Carlsbecker et al. (Nature 2010, 465, 316-321). In wild-type plants, small proteins (such as the green fluorescence protein GFP) driven by the companion cell specific SUC2 promoter (Imlau et al., Plant Cell 1999, 11, 309-322) traffic through the phloem and freely diffuse throughout the entire root tip as shown in the first panel of FIG. 2A; the arrows in FIG. 2A show the extent of GFP diffusion in the root tip. Three allelic semi-dominant mutants were identified, named cals3-1d, -2d, and -3d and collectively referred to as cals3-d. These plants were identified in part based upon an aberrant pattern of pSUC2::GFP localization. The cals3-d showed a weak, fragmented pattern of pSUC2::GFP in the upper part of the root and no GFP signal in the elongation and meristematic zones of root tip (FIG. 2A) indicating defective establishment of phloem identity and decreased diffusion of GFP in cals3-d. All of the cals3-d had a similar phenotype including shorter roots than wild-type, indicating that all the mutations lead to similar phenotypes.

To analyze the cals3-d mutations at a molecular level, they were mapped using standard genetic techniques used in the art (see e.g. Carlsbecker et al., 2010) to the At5g13000 locus (FIG. 2B), which encodes a putative callose synthase (Hong et al., Plant Cell 2001, 13, 755-768), CALLOSE SYNTHASE3 (CALS3)/GLUCAN SYNTHASE12 (GSL12). The genomic sequence of the locus At5g13000 encoding CALS3, starting from the ATG start codon and ending in the TGA stop codon and introns inclusive is shown in SEQ ID 56. The mutations are described in detail in Table 1 and shown in the schematic of FIG. 2B.

TABLE 1

| Name | Type | Intron/exon | Position in sequence as set forth in SEQ ID NO. 56 | Change of amino acid sequence as set forth in SEQ ID NO. 1 |
|---|---|---|---|---|
| cals3-1d | G to A substitution | 2$^{nd}$ exon | 336 | R to K in position 84 |
| cals3-2d | G to A substitution | Last exon | 10691 | R to K in position 1926 |
| cals3-3d | C to T substitution | 5$^{th}$ exon | 970 | P to L in position 189 |

All three mutations are in the predicted cytosolic face of CALS3 (the predicted structure shown in Hong et al., 2001). This indicates that the regions of the polypeptide on the predicted cytosolic face, corresponding to regions encoded by exons 2-5 and the last exon of the gene encoding CALS3, are important, and the conserved amino acids are crucial for the function of callose synthase.

Example 2. Callose Level Analysis in Plants Expressing the Mutant CalS3 Polypeptide In order to approach the effect of the cals3-d mutations on callose biosynthesis, callose levels in the root meristem and stele were examined based upon aniline blue (AB) staining as described by Ingram et al. (Plant Journal 2011, 68(3), 455-467). Aniline blue staining was performed using aniline blue fluorochrome (Biosupplies Australia Pty. Ltd.). A stock solution (0.1 mg/ml in H$_2$O) was diluted 1:3 ratio with 67 mM K$_3$PO$_4$ pH 9.5. Seedlings were incubated in the staining solution for 2 hours at RT and imaged in Citifluor/PBS solution (Citifluor Ltd.) on a Leica SP5 or SP2 confocal using a UV laser.

Figure 3:
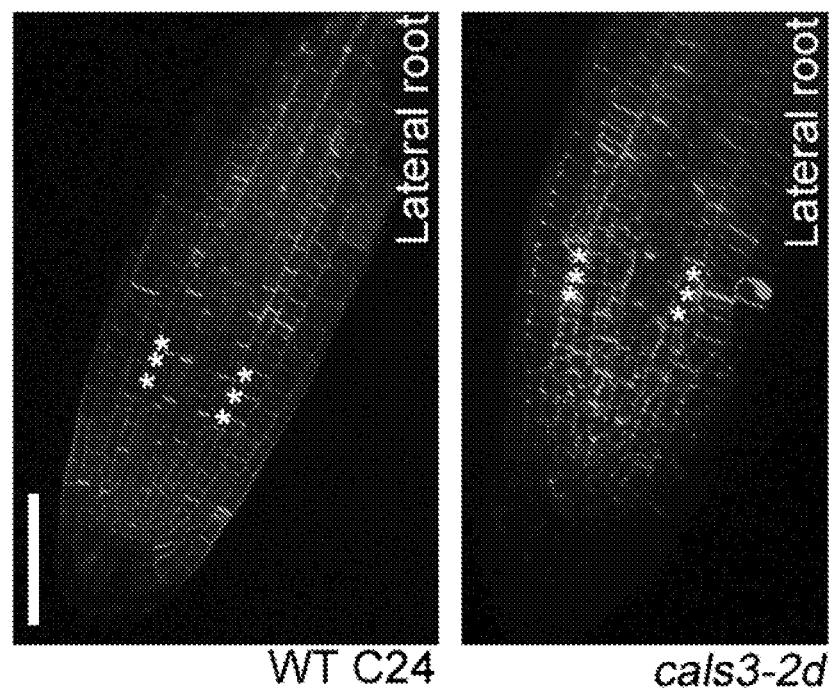
FIG. 3 demonstrates aniline blue stained young lateral root of wild-type plants and plants comprising homozygous mutations of CalS3.

A strong signal was detected in the phloem tissue of young lateral roots of wild-type seedlings (FIG. 3, first panel). The sieve plates were clearly identified with a strong, even staining pattern. The lateral walls of protophloem sieve elements were also intensely stained, but unlike sieve plates these walls displayed punctate staining that could be interpreted as being located at plasmodesmata. In addition to the phloem, the transverse walls of most root cells displayed strong staining; white asterisks in FIG. 3 denote the endodermal cell layer. In order to understand the effect of the cals3-d mutations on callose accumulation, callose staining was analyzed in the early stages of lateral root development. Young lateral roots of cals3-d typically displayed clearly stronger staining than wild-type (FIG. 3, second panel).

Example 3. Production of Transgenic Plants Expressing Mutated CalS3

The vector pGreen-CALS was created by amplifying a 13 kb genomic sequence corresponding to the At5g13000 gene using BAC-clone T24H18 as a template and cloning it as three fragments into the pGreenII0179. The 3.1 kb genomic sequence was PCR amplified with primers flanked by NotI and NcoI, XhoI sites. The NotI-XhoI fragment was then ligated to NotI-XhoI linearized vector. 5.3 kb genomic sequence was then PCR amplified flanked by NcoI and XhoI, HpaI sites. The NcoI-XhoI fragment was then ligated to NcoI-XhoI linearized vector. 4.7 kb genomic sequence was then PCR amplified flanked by HpaI and XhoI sites and eventually HpaI-XhoI fragment was ligated to HpaI-XhoI linearized vector to yield pGreen-CALS3. The resulting vector comprised the sequence encoding SEQ ID NO. 2 operably linked to the promoter of the open reading frame At5g13000.

Primers used to amplify:

3.1 kb genomic fragment: 5'-AATATGCGGCCGCgctcgtccttcgttcctta-3' (SEQ ID NO: 59) and 5'-AATATCTCGAGtgcagttacatatatattccatgga-3' (SEQ ID NO: 60), 5.3 kb genomic fragment: 5'-AATATtccatggaatatatatgtaactgca-3' (SEQ ID NO: 61) and 5'-AATATCTCGAGggctacgttaacagcatatgaaca-3' (SEQ ID NO: 62), 4.7 kb genomic fragment: 5'-TGTTCATATGCTGTTAACGTAG-3' (SEQ ID NO: 63) and 5'-TTAATCTCGAGgaagaagagtgagcaagtagtgagg-3' (SEQ ID NO: 64).

Figure 4:
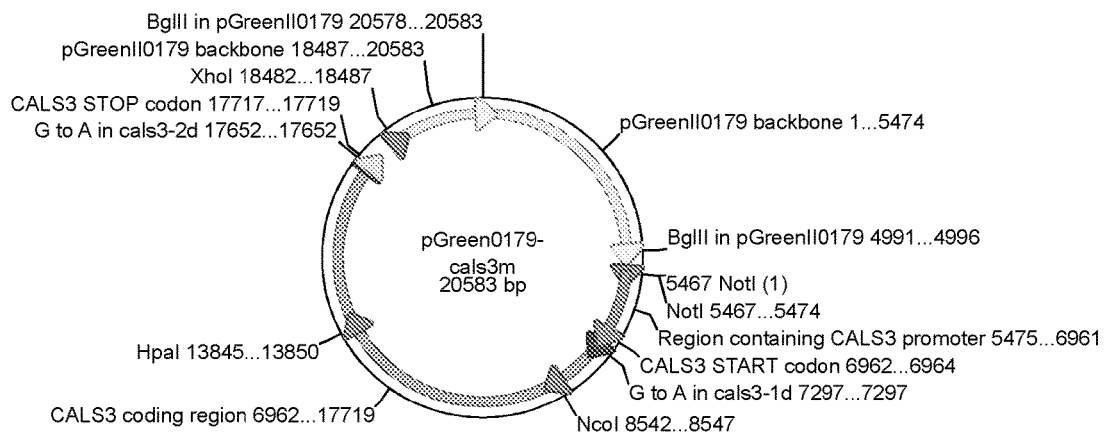
FIG. 4A shows a map of pGreen-cals3m.
FIG. 4B demonstrates the phenotype of wild-type plants transformed with pGreen-cals3m.
Figure 4:
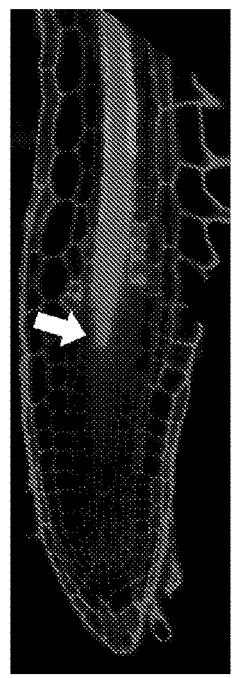

PCR-based site directed mutagenesis was used to artificially introduce cals3-1d, cals3-2d and cals3-1d+2d mutations to pGreen-CALS3 to produce the vector pGreen-cals3m plasmid set forth in SEQ ID NO: 57 and in FIG. 4A. Complimentary primer pairs containing cals3-1d/cals3-2d mutations surrounded by unmodified sequence were designed. PCR reaction was performed using Pfu turbo polymerase (Stratagene), forementioned primers, and pGreen-cals3 (amplified in DH5α E. coli strain) as a template. Here, 1-1.5 minute/kb elongation time and 15-17 cycles were used. Subsequently, the PCR mix was digested with DpnI to remove methylated non-mutated DNA (template); DpnI digests only methylated or hemimethylated DNA (methylated by dam methylase present in DH5α cells) and hence newly amplified non-methylated DNA will not be degraded. The PCR mix was transformed to E. coli using a standard protocol. Presence of the desired mutation in the resulting colonies was confirmed by sequencing.

The cals3-1d mutation was introduced using the primers 5'-CTTAAACTGCCGAACACCTTTTCCACTGGAGGTAGGATCC-3' (SEQ ID NO: 65) and 5'-GGATCCTACCTCCAGTGGAAAAGGTGTTCGGCAGTTTAAG-3' (SEQ ID NO: 66).

The cals3-2d mutation was introduced using primers 5'-GGATACGAGAGATCTGAAGACCTTTACTGAAAGCTTG-3' (SEQ ID NO: 67) and 5'-CAAGCTTTCAGTAAAGGTCTTCAGATCTCTCGTATCC-3' (SEQ ID NO: 68).

The clone in the binary vector was transformed into *Agrobacterium* GV3101 with pSOUP (Hellens et al., Plant Molecular Biology 2000, 42, 819-832) and transformed to wild-type plants.

The vector was introduced into *Arabidopsis thaliana* plants of the Col-0 ecotype using the standard transformation technique used in the art, i.e. the floral dip method (Clough and Bent, Plant Journal 1998, 16(6), 735-743). Transgenic plants containing the cals3m fragment displayed partial phenocopy of cals3-d phenotype (FIG. 4B).

Example 4. Cloning of pEN-cals3m

Figure 5:
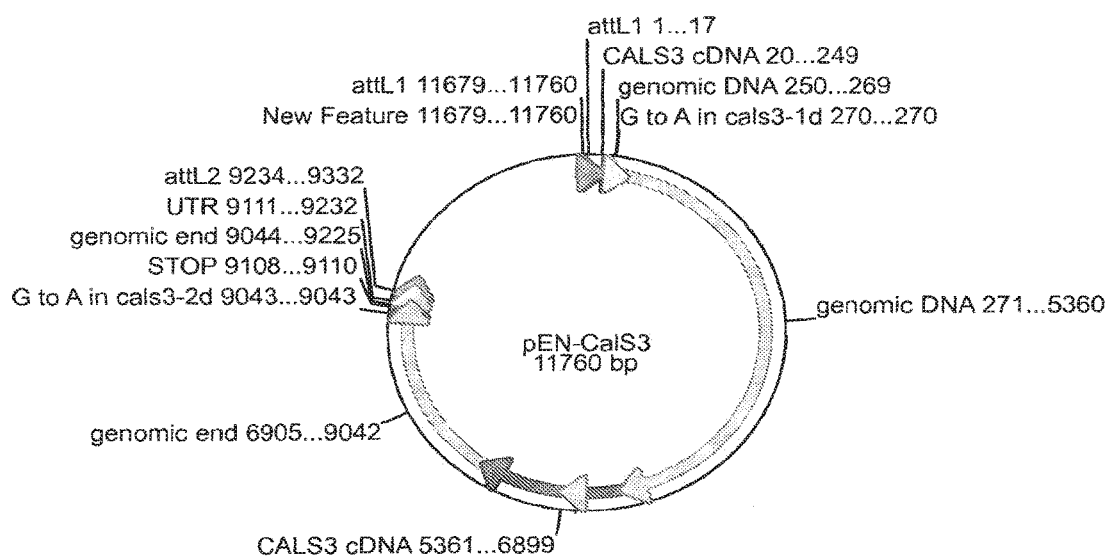
FIG. 5 shows a map of pEN-cals3m.

In order to clone a polynucleotide for use in expression cassettes and vectors of the present invention, both cDNA and gDNA were used as a template to create pEN-cals3m (SEQ ID NO: 58, map shown in FIG. 5). First fragment was amplified using cals3-1d cDNA as a template and cloned to pGEM-T vector (Promega). A 2.6 kb cDNA sequence containing cals3-1d mutation was PCR amplified flanked by NcoI-NotI. The NcoI-NotI fragment was then ligated to NcoI-NotI linearized vector. Second, a 1.9 kb fragment was PCR amplified using cDNA as a template flanked by KpnI-NotI. The KpnI-NotI fragment was then ligated to KpnI-NotI linearized vector. Third, 2.4 kb fragment was PCR amplified using complementation construct pGreen-cals3-2d as a template flanked by SpeI-NotI. The SpeI-NotI fragment containing cals3-2d mutation was then ligated to SpeI-NotI linearized vector to yield hybrid sequence containing cDNA and gDNA and both cals3-1d and cals3-2d mutations. This sequence was amplified with primers 5'-AAAAAGCAGGCTCAATGTCTGCTACGAGAG-GAGGTC-3' (SEQ ID NO: 69) and 5'-AGAAAGCTGGGTTtactacaatgtttttacctaagcgata-3' (SEQ ID NO: 70) and with adapter primers recommended by the manufacturer and recombined to pDONR (221). Resulting pEN-cals3m vector was continuously losing part of the cDNA during the BP recombination reaction. Therefore, 6 kb genomic fragment was amplified using pGreen-cals3-1d as template using primers 5'-caaaATGTCTGCTACGA-GAGGA-3' (SEQ ID NO: 71) and 5'-GGTAGAAAGTCGC-CAACCTC-3' (SEQ ID NO: 72). This fragment contains unique restriction sites BamHI-SacI inside the genomic sequence. The 5 kb BamHI-SacI fragment was then ligated to BamHI-SacI linearized vector to yield pEN-cals3m. The resulting pEN-cals3m thus comprised a polynucleotide encoding a polypeptide with two mutations, R84K and R1926K.

Primers used to amplify cDNA:
2.6 kb fragment: 5'-AATATCCATGGcaaaATGTCTGC-TACGAGAGGA-3' (SEQ ID NO: 73) and 5'-AATATGCG-GCCGCTGAGATCCAAATCACGGTCA-3' (SEQ ID NO: 74),
1.9 kb fragment: 5'-TACGGAGGATAAGGTACCT-GTGA-3' (SEQ ID NO: 75) and 5'-AATATGCGGCCGCT-GCCAATAATCTCTGACCAATG-3' (SEQ ID NO: 76),
Primers used to amplify gDNA:
2.4 kb fragment: 5'-TTTCATCCCTTGCTTGGTTC-3' (SEQ ID NO: 77) and 5'-AATATGCGGCCGCtactacaatgtttt-tacctaagcgata-3' (SEQ ID NO: 78).

Example 5. Immunocytochemical Study of Callose Localization in the Secondary Xylem In order to modify and study wood formation and/or composition, irx3-1 mutants (*Arabidopsis thaliana*, Ler ecotype) were transformed with the constructs pIRX8: cals3m or pZCP4:cals3m (constructed according to known methods). The irx3-1 mutation has previously been described by Turner and Somerville, Plant Cell 1997, 9, p. 689-701, and by Taylor et al., Plant Cell 1999, 11, p. 769-779. The promoter of the ZCP4 gene (pZCP4) has previously been described by Pyo et al., Plant Cell Physiology 2004, 45(10), p. 1529-1536. The promoter of the IRX8 gene (pIRX8) has previously been described by Peña et al., Plant Cell 2007, 19, p. 549-563.

T2 plants were grown on short day conditions in the greenhouse and ~2 months after the germination, 1 cm samples below shoot were collected to 1×PBS buffer (pH 7.4) and fixed in 4% paraformaldehyde for 1 hour in vacuum at RT, followed by overnight fixation at +4 C.

Immunocytochemical staining was done essentially as described by Paciorek et al., Nature Protocols 2006, 104 (1), p. 104-107. Samples were washed (4× with 1×MTSB, 1× 1×PBS), dehydrated (by incubating samples in 25%, 50%, 75% and in 96% Ethanol for 1 hour at RT) and embedded to freshly made Steedmans wax (9:1 ratio of PEG 400 and 1-hexadecanol (by incubating samples in 96% ethanol, wax/ethanol 1:2, 1:1, 2:1, and in 100% wax for 1 hour at 37 C). Samples were arranged to small petri dish, embedded to wax and stored overnight at +4° C. Blocks containing the samples were trimmed, attached to pieces of wood and cutted with microtome to 10 μm sections. Section were collected to slides and slides were let to dry overnight at RT. Samples were dewaxed (by washing slides with 99%, 90%, 50% ethanol for 10 minutes at RT and 1×PBS for 20 minutes at RT), blocked with 2% BSA solution (30 minutes at RT) and labeled with primary antibody (monoclonal antibody to (1–>3)-beta-glucan, Biosupplies Australia, Cat. No. 400-2, diluted to ratio of 1:400 with 2% BSA) in humid chamber overnight at RT. Slides were washed (4×1×MTSB for 10 minutes at RT) and labeled with secondary antibody (IgG goat anti-mouse IgG (H+L) conjugated with FITC, Dianova, Cat. No. 115-095-003 diluted to ratio of 1:400 with 2% BSA) in humid chamber for 90 minutes at RT. Slides were washed (4×1×MTSB for 10 minutes at RT) and drops of antifading mounting media (Citifluor/PBS solution (Citifluor Ltd.) was added to slides. Analysis was done on a Leica SP5 confocal using a solid state blue laser (480 nm/270 mW).

Figure 6:
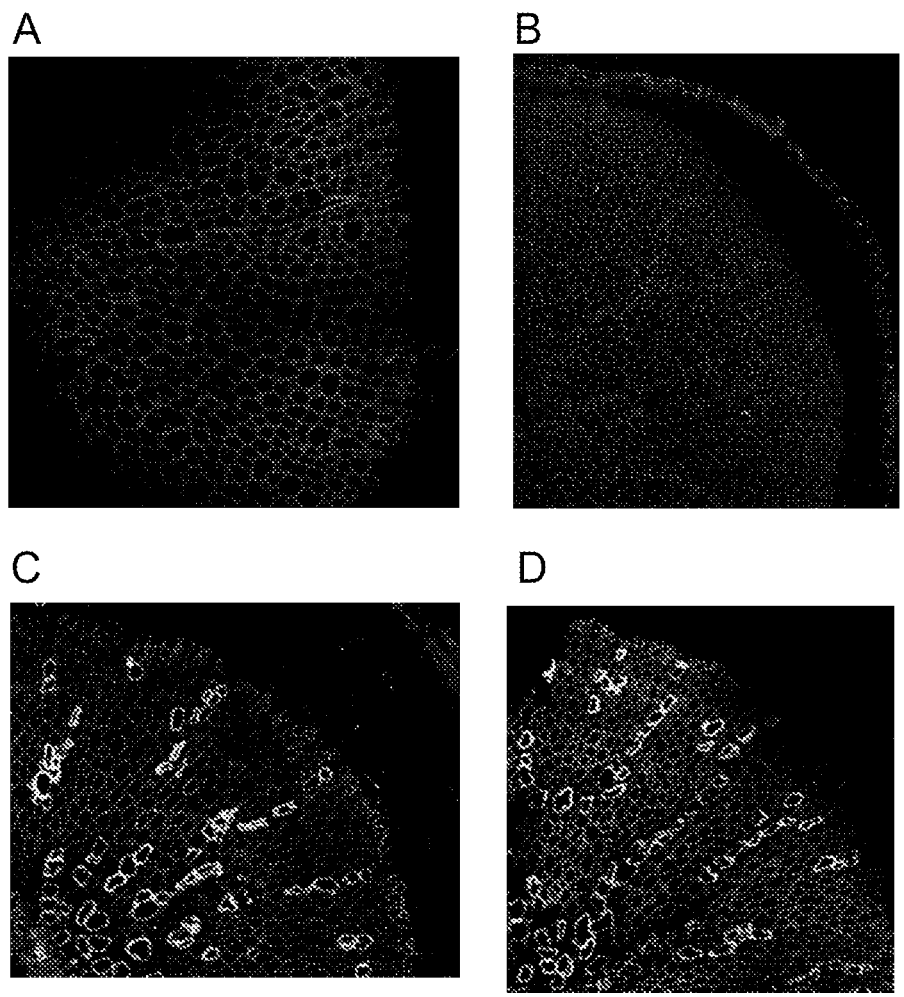
FIG. 6 shows the results of an immunocyto-chemical study of callose localization in the secondary xylem.

Strong signal, indicating the presence of increased amounts of callose, was observed in xylem tissue during secondary growth of the root in plants containing either pIRX8::cals3m (FIG. 6C) or pZCP4::cals3m (FIG. 6D) in irx3. FIGS. 6A and 6B show corresponding control samples stained without the primary antibody. The result demonstrates that the polypeptide of the invention is capable of producing significant amounts of callose in xylem tissues and thus modifying wood formation and/or composition in plants.

As is clear for a person skilled in the art, the invention is not limited to the examples and embodiments described above, but the embodiments can freely vary within the scope of the claims.

SEQUENCE LISTING (78 sequences)

SEQ ID NO: 1 - protein, 1947 aa, Arabidopsis thaliana
  CalS3 protein WT
MSATRGGPDQGPSQPQQRRIIRTQTAGNLGESFDSEVVPSSLVEIAPILRVANEVESSNPRVAYLCRFYAFEKAHRLDPTSSGRGVRQFKTALLQRLEREHDPTLMGRVKKSDAREMQSFYQHYYKKYIQALHNAADKADRAQLTKAYQTANVLFEVLKAVNLTQSIEVDREILEAQDKVAEKTQLYVPYNILPLDPDSANQAIMRYPEIQAAVLALRNTRGLPWPEGHKKKKDEDMLDWLQEMFGFQKDNVANQREHLILLLANVHIRQFPKPDQQPKLDDQALTEVMKKLFKNYKKWCKYLGRKSSLWLPTIQQEMQQRKLLYMALYLLIWGEAANLRFMPECLCYIYHHMAFELYGMLAGNVSPMTGENVKPAYGGEEDAFLRKVVTPIYEVIQMEAQRSKKGKSKHSQWRNYDDLNEYFWSVDCFRLGWPMRADADFFCLPVAVPNTEKDGDNSKPIVARDRWVGKVNFVEIRSFWHVFRSFDRMWSFYILCLQAMIIMAWDGGQPSSVFGADVFKKVLSVFITAAIMKLGQAVLDVILNFKAHQSMTLHVKLRYILKVFSAAAWVIILPVTYAYSWKDPPAFARTIKSWFGSAMHSPSLFIIAVVSYLSPNMLAETNENLLLCCLTDVTIINTLQPRLYVGRGMHESAFSLFKYTMFWVLLIATKLAFSYYIEIRPLVAPTQAIMKARVTNFQWHEFFPRAKNNIGVVIALWAPIILVYFMDSQIWYAIFSTLFGGIYGAFRRLGEIRTLGMLRSRFESLPGAFNDRLIPDGKNQQKKKGIRATLSHNFTEDKVPVNKEKEAARFAQLWNTIISSFREEDLISDREMDLLLVPYWADRDLDLIQWPPFLLASKIPIALDMAKDSNGKDRELKKRIESDTYMKCAVRECYASFKNIIKFVVQGNREKEVIEIIFAEVDKHIDTGDLIQEYKMSALPSLYDHFVKLIKYLLDNKEEDRDHVVILFQDMLEVVTRDIMMEDYNISSLVDSSHGGTWHGGMIPLEQQYQLFASSGAIRFPIEPVTEAWKEKIKRIYLLLTTKESAMDVPSNLEARRRISFFSNSLFMDMPMAPKVRNMLSFSVLTPYYTEEVLFSLRDLETPNEDGVSILFYLQKIFPDEWNNFLERVKCLSEEELKESDELEEELRLWASYRGQTLTRTVRGMMYYRKALELQAFLDMAMHEDLMEGYKAVELNSENNSRGERSLWAQCQAVADMKFTYVVSCQQYGIHKRSGDPRAQDILRLMTRYPSLRVAYIDEVEEPVKDKSKKGNQKVYYSVLVKVPKSTDHSTLAQNLDQVIYRIRLPGPAILGEGKPENQNHAIIFSRGEGLQTIDMNQDNYMEEALKMRNLLQEFLTKHDGVRHPSILGLREHIFTGSVSSLAWFMSNQETSFVTIGQRLLANPLRVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMMSCYFTTVGFYFSTLITVLTVYIFLYGRLYLVLSGLEQGLSTQKGIRDNTPLQIALASQSFVQIGFLMALPMLMEIGLERGFRTALSEFVLMQLQLAPVFFTFSLGTKTHYYGRTLLHGGAKYRSTGRGFVVFHAKFADNYRLYSRSHFVKGLEMMLLLVVYQIFGSAYRGVLAYLLITISMWFMVGTWLFAPFLFNPSGFEWQKIVDDWTDWNKWINNIGGIGVPAEKSWESWWEEEQEHLRYSGKRGIVVEILLALRFFIYQYGLVYHLTITEKTKNFLVYGVSWLVIFLILFVMKTVSVGRRRFSASFQLMFRLIKGLIFMTFIAIIVILITLAHMTIQDIIVCILAFMPTGWGMLLIAQACKPVVHRAGFWGSVRTLARGYEIVMGLLLFTPVAFLAWFPFVSEFQTRMLFNQAFSRGLQISRILGGHRKDRSSRNKE

SEQ ID NO: 2 - protein, 1950 aa, Arabidopsis thaliana
  Locus At1g05570
MAQRREPDPPPPQRRILRTQTVGSLGEAMLDSEVVPSSLVEIAPILRVANEVEASNPRVAYLCRFYAFEKAHRLDPTSSGRGVRQFKTALLQRLERENETTLAGRQKSDAREMQSFYQHYYKKYIQALLNAADKADRAQLTKAYQTAAVLFEVLKAVNQTEDVEVADEILETHNKVEEKTQIYVPYNILPLDPDSQNQAIMRLPEIQAAVAALRNTRGLPWTAGHKKKLDEDILDWLQSMFGFQKDNVLNQREHLILLLANVHIRQFPKPDQQPKLDDRALTIVMKKLFRNYKKWCKYLGRKSSLWLPTIQQEVQQRKLLYMGLYLLIWGEAANLRFMPECLCYIYHHMAFELYGMLAGSVSPMTGEHVKPAYGGEDEAFLQKVVTPIYQTISKEAKRSRGGKSKHSVWRNYDDLNEYFWSIRCFRLGWPMRADADFFCQTAEELRLERSEIKSNSGDRWMGKVNFVEIRSFWHIFRSFDRLWSFYILCLQAMIVIAWNGSGELSAIFQGDVFLKVLSVFITAAILKLAQAVLDIALSWKARHSMSLYVKLRYVMKVGAAAVWVVVMAVTYAYSWKNASGFSQTIKNWFGGHSHNSPSLFIVAILIYLSPNMLSALLFLFPFIRRYLERSDYKIMMLMMWWSQPRLYIGRGMHESALSLFKYTMFWIVLLISKLAFSYYAEIKPLVGPTKDIMRIHISVYSWHEFFPHAKNNLGVVIALWSPVILVYFMDTQIWYAIVSTLVGGLNGAFRRLGEIRTLGMLRSRFQSIPGAFNDCLVPQDNSDDTKKKRFRATFSRKFDQLPSSKDKEAARFAQMWNKIISSFREEDLISDREMELLLVPYWSDPDLDLIRWPPFLLASKIPIALDMAKDSNGKDRELKKRLAVDSYMTCAVRECYASFKNLINYLVVGEREGQVINDIFSKIDEHIEKETLITELNLSALPDLYGQFVRLIEYLLENREEDKDQIVIVLLNMLELVTRDIMEEEVPSLLETAHNGSYVKYDVMTPLHQQRKYFSQLRFPVYSQTEAWKEKIKRLHLLLTVKESAMDVPSNLEARRRLTFFSNSLFMDMPPAPKIRNMLSFSVLTPYFSEDVLFSIFGLEQQNEDGVSILFYLQKIFPDEWTNFLERVKCGNEEELRAREDLEEELRLWASYRGQTLTKTVRGMMYYRKALELQAFLDMAKDEELLKGYKALELTSEEASKSGGSLWAQCQALADMKFTFVVSCQQYSIHKRSGDQRAKDILRLMTTYPSIRVAYIDEVEQTHKESYKGTEEKIYYSALVKAAPQTKPMDSSESVQTLDQLIYRIKLPGPAILGEGKPENQNHAIIFTRGEGLQTIDMNQDNYMEEAFKMRNLLQEFLEKHGGVRCPTILGLREHIFTGSVSSLAWFMSNQENSFVTIGQRVLASPLKVRFHYGHPDIFDRLFHLTRGGICKASKVINLSEDIFAGFNSTLREGNVTHHEYIQVGKGRDVGLNQISMFEAKIANGNGEQTLSRDLYRLGHRFDFFRMLSCYFTTIGFYFSTMLTVLTVYVFLYGRLYLVLSGLEEGLSSQRAFRNNKPLEAALASQSFVQIGFLMALPMMMEIGLERGFHNALIEFVLMQLQLASVFFTFQLGTKTHYYGRTLFHGGAEYRGTGRGFVVFHAKFAENYRFYSRSHFVKGIELMILLLVYQIFGQSYRGVVTYILITVSIWFMVVTWLFAPFLFNPSGFEWQKIVDDWTDWNKWIYNRGGIGVPPEKSWESWWEKELEHLRHSGVRGITLEIFLALRFFIFQYGLVYHLSTFKGKNQSFWVYGASWFVILFILLIVKGLGVGRRRFSTNFQLLFRIIKGLVFLTFVAILITFLALPLITIKDLFICMLAFMPTGWGMLLIAQACKPLIQQLGIWSSVRTLARGYEIVMGLLLFTPVAFLAWFPFVSEFQTRMLFNQAFSRGLQISRILGGQRKDRSSKNKE

SEQ ID NO: 3 - protein, 1950 aa, Arabidopsis thaliana
  Encoded by locus AT2G31960
MAQRKGPDPPPPQRRILRTQTAGNLGEAMLDSEVVPSSLVEIAPILRVANEVEASNPRVAYLCRFYAFEKAHRLDPTSSGRGVRQFKTALLQRLERENETTLAGRQKSDAREMQSFYQHYYKKYIQALQNAADKADRAQLTKAYQTAAVLFEVLKAVNQTEDVEVADEILEAHTKVEEKSQIYVPYNILPLDPDSQNQAIMRFPEIQATVSALRNTRGLPWPAGHKKKLDEDMLDWLQTMFGFQKDNVSNQREHLILLLANVHIRQFPRPEQQPRLDDRALTIVMKKLFKNYKKWCKYLGRKSSLWLPTIQQEVQQRKLLYMGLYLLIWGEAANLRFLPECLCYIYHHMAFELYGMLAGSVSPMTGEHVKPAYGGEDEAFLQKVVTPIYKTIAKEAKRSRGGKSKHSEWRNYDDLNEYFWSIRCFRLGWPMRADADFFCQTAEELRLDRSENKPKTGDRWMGKVNFVEIRSFWHIFRSFDRMWSFYILSLQAMIIIAWNGSGKLSGIFQGDVFLKVLSIFITAAILKLAQAVLDIALSWKSRHSMSFHVKLRFIFKAVAAAIWVVLMPLTYAYSWKTPSGFAETIKNWFGGHQNSSPSFFIIVILIYLSPNMLSTLLFAFPFIRRYLERSDYKIVMLMMWWSQPRLYIGRGMHESALSLFKYTMFWVVLLISKLAFSFYAEIKPLVKPTKDIMRVHISVYRWHEFFPHAKSNMGVVIALWSPVILVYFMDTQIWYAIVSTLVGGLNGAFRRLGEIRTLGMLRSRFQSLPEAFNACLVPNEKSETPKKKGIMATFTRKFDQVPSSKDKEAARFAQMWNKIISSFREEDLISDREMELLLVPYWADRDLDLIRWPPFLLASKIPIALDMAKDSNGKDRELTKRLSVDSYMTCAVRECYASFKNLINFLVVGEREGQVINEIFSRIDEHIEKETLIKDLNLSALPDLYGQFVRLIEYLMENREEDKDQIVIVLLNMLEVVTRDIMDEEVPSMLESTHNGTYVKYDVMTPLHQQRKYFSQLRFPVYSQTEAWKEKIKRLHLLLTVKESAMDVPSNLEARRRLTFFSNSLFMEMPDAPKIRNMLSFSVLTPYYSEDVLFSIFGLEKQNEDGVSILFYLQKIFPDEWTNFLERVKCGSEEELRAREELEEELRLWASYRGQTLTKTVRGMMYYRKALELQAFLDMAKDEELMKGYKALELTSEDASKSGTSLWAQCQALADMKFTFVVSCQQYSVQKRSGDQRAKDILRLMTTYPSLRVAYIDEVEQTHKESYKGADEKIYYSALVKAAPQTKSMDSSESVQTLDQVIYRIKLPGPAILGEGKPENQNHSIIFTRGEGLQTIDMNQDNYMEEAFKMRNLLQEFLVKHGGVRTPTILGLREHIFTGSVSSLAWFMSNQENSFVTIGQRVLASPLKVRFHYGHPDVFDRLFHLTRGGVCKASKVINLSEDIFAGFNSTLREGNVTHHEYIQVGKGRDVGLNQISMFEAKIANGNGEQTLSRDLYRLGHRFDFFRMLSCYFTTIGFYFSTMLTVLTVYVFLYGRLYLVLSGLEEGLSNQKAFRSNMPLQAALASQSFVQIGFLMALPMMMEIGLERGFHNALIDFVLMQLQLASVFFTFQLGTKTHYYGRTLFHGGAEYRGTGRGFVVFHAKFAENYRFYSRSHFVKGIELMILLLVYQIFGHAYRGVVTYILITVSIWFMVVTWLFAPFLFNPSGFEWQKIVDDWTDWNKWIYNRGGIGVPPEKSWESWWEKEIGHLRHSGKRGIILEIVLALRFFIFQYGLVYQLSTFKQENQSLWIYGASWFVILFILLIVKGLGVGRQRFSTNFQLLFRIIKGFVFLTFLGLLITFLALRFLTPKDIFLCMLAFMPTGWGMLLIAQACKPLIQRLGFWSSVRTLARGYEILMGLLLFTPVAFLAWFPFVSEFQTRMLFNQAFSRGLQISRILGGQRKDRSSKNKE

SEQ ID NO: 4 - protein, 1871 aa, Arabidopsis thaliana
  Encoded by locus At5G36870
MNQPNRGQILQTVFSHFFPVASPDSELVPSSLHEDITPILRVAKDVEDTNPRSLFLQDLDIKSVDDSINILSGHSHALDKANELDPTSSGRDVRQFKNTILQWLEKNNESTLKARQKSSDAHEMQSFYQQYGDEGINDLLNAGAGSSSSQRTKIYQTAVVLYDVLDAVHRKANIKVAAKILESHAEVEAKNKIYVPYNILPLDPDSKNHAMMRDPKIVAVLKAIRYTSDLTWQIGHKINDDEDVLDWLKTMFRFQKDNVSNQREHLILLLANVQMRQTQRQPNLLDDRALDTVMEKLLGNYNKWCNHVGLESSLRFPKDKQQKVVQQRKLLYTGLYLLIWGEAANLRFMPECLCYIYHHMAFELFEMLESKGSKKKYKPKNPTYSGKDEDFLTKVVTPVYKTIAEEAKKSGEGKHSEWRNYDDLNEYFWSKQYLDKLGWPMKANADFFCKTSQQLGLNKSEKKPDLGDGCVGKVNFVEIRTFWHLFRSFDRMWSFYILSLQAMIIIAWNETSESGGAVFHKVLSVFITAAKLNLFQAFLDIALSWKARHSMSTHVRQRYIFKAVAAAVWVLLMPLTYAYSHTSIFIVAILIYLSPNMLPEMLLLIPSIRRTLEKSDFRPVKLIMWWSQPELYIGRGMHESAWSIYKYMMFWIVLLTSKLAFSYYVEQIKPLMGPTKEIMSVPMPGYWLPEFFPHVKNNRGVVITLWSPVILVYFMDTQIWYAIVSTLVGGLYGAFRHIGEIQTLGMLRSRFQSLPGAFNACLIPNENTKEKGIKLAFSRKCHKIPNTNGKEAKQFSQMWNTIINSFREEDLISNRELELLLMSCWAYPDLDFIRWPIFLLASKIPIAVDIAKKRNGKHRELKNILAEDNCMSCAVRECYASIKKLLNTLVTGNSDLMLITTVFTIIDTHIEKDTLLTELNLSVLPDLHGHFVKLTEYVLQNKDKDKIQIVNVLLKILEMVTKDILKEEIKRLHLLLTVKESAMDVPSNLEARRRLTFFSNSLFMEMPGAPKIQNMLSFSALTPYYSEDVLFSTFDLEKENDGVSILFYLQKIFPDEWKNFLERVKCGTEEELDAIDYLKEEIRLWASYRGQTLTKTVRGMMYYQKALELQAFFDLANERELMKGYKSAEASSSGSSLWAECQALADIKFTYVVACQQYSIHKRSGDQRAKDILTLMTTYPSLRVAYIDEVEQTHIYSKGTSENFYYSALVKAAPQTYSTDSSDSGHMLDQVIYQIKLPGPPIIGEGKPENQNNAIIFTRGEALQTIDMNQDYYIEEAFKMRNLLQEFLEKNGGVRYPTILGLREHIFTRSVSCLAWFMSNQEHSFVTIGQRVLANPLKVRFHYGHPDVFDRVFHLTRGGVSKASKVINLSEDIFAGFNSTLREGTVSHHEYIQVGKGRDVGLNQISMFEAKIANGSGEQTLSRDLYRLGHQFDFFRMLSCYFTTVGFYFCSMLTVLTVYVFLYGRLYLVLSGVEKELGNKPMMMEIILASQSFVQIVFLMAMPMIMEIGLERGFYDALFDFVLMQLQLASVFFTFQLGTKFHYYCKTLLHGGAEYRGTGRGFVVFHAKFAENYRFYSRSHFVKATELGILLLVYHIFGPTYIGLFTISIWFMVGTWLFAPFLFNPSGFEWHEIVEDWADWKKWIEYDNGGIGVPPEKSWESWWEKDIEHLQHSGKWGIVVEIFFALRFFIFQYGLVYQLSAFKNKYSSLWVFGASWLLILILLLTVTVLDYARRRLGTEFQLLFRIIKVSLFLAFMAIFITLMTCRLILPQDVFLCMLALIPTGWGLLLIAQSCKPLIQQPGIWSWVMTLAWVYDLVMGSLLFIPIAFMAWFPFISEFQTRMLFNQAFSRGLHISRILSGQRKHRSSKNKD

SEQ ID NO: 5 - protein, 1923 aa, Arabidopsis thaliana
  Encoded by locus At2G13680
MAQSSTSHDSGPQGLMRRPSRSAATTVSIEVFDHEVVPASLGTIAPILRVAAEIEHERPRVAYLCRFYAFEKAHRLDPSSGGRGVRQFKTLLFQRLERDNASSLASRVKKTDGREVESFYQQYYEHYVRALDQGDQADRAQLGKAYQTAGVLFEVLMAVNKSEKVEAVAPEIIAAARDVQEKNEIYAPYNILPLDSAGASQSVMQLEEVKAAVAALGNTRGLNWPSGFEQHRKKTGNLDLLDWLRAMFGFQRDNVRNQREHLVCLFADNHIRLTPKPEPLNKLDDRAVDTVMSKLFKNYKNWCKFLGRKHSLRLPQAAQDIQQRKILYMGLYLLIWGEAANIRFMPECLCYIFHNMAYELHGLLAGNVSIVTGENIKPSYGGDDEAFLRKVITPIYRVVQTEANKNANGKAAHSDWSNYDDLNEYFWTPDCFSLGWPMRDDGDLFKSTRDTTQGKKGSFRKAGRTGKSNFTETRTFWHIYHSFDRLWTFYLLALQAMIILAFERVELREILRKDVLYALSSIFITAAFLRFLQSVLDVILNFPGFHRWKFTDVLRNILKIVVSLAWCVVLPLCYAQSVSFAPGKLKQWLSFLPQVKGVPPLYIMAVALYLLPNVLAAIMFIFPMLRRWIENSDWHIFRLLLWWSQPRIYVGRGMHESQIALIKYTIFWLLLFCCKFAFSYFLQVKLLVKPTNAIMSIRHVKYKWHEFFPNAEHNYGAVVSLWLPVILVYFMDTQIWYAIFSTICGGVIGAFDRLGEIRTLGMLRSRFQSLPGAFNTYLVPSDKTRRRGFSLSKRFAEVTAARRTEAAKFSQLWNEIISSFREEDLISDREMDLLLVPYTSDPSLKLIQWPPFLLASKIPIALDMAAQFRTRDSDLWKRICADEYMKCAVIECYESFKHVLHTLVIGENEKRIIGIIIKEVESNISKNSFLSNFRMAPLPALCSKFVELVGILKNADPAKRDTVVLLLQDMLEVVTRDMMQNENRELVELGHTNKESGRQLFAGTDAKPAILFPPVATAQWHEQISRLHLLLTVKESAMDVPTNLEAQRRIAFFTNSLFMDMPRAPRVRNMLSFSVLTPYYSEETVYSKNDLEMENEDGVSVVYYLQKIFPDEWTNFLERLDCKDETSVLESEENILQLRHWVSLRGQTLFRTVRGMMYYRRALKLQAFLDMANETEILAGYKAISEPTEEDKKSQRSLYTQLEAVADLKFTYVATCQNYGNQKRSGDRRATDILNLMVNNPSLRVAYIDEVEEREGGKVQKVFYSVLIKAVDNLDQEIYRIKLPGPAKIGEGKPENQNHALIFTRGEALQAIDMNQDHYLEEALKMRNLLEEFNEDHGVRAPTILGFREHIFTGSVSSLAWFMSNQETSFVTIGQRVLASPLKVRFHYGHPDVFDRIFHITRGGISKASRGINLSEDIFAGFNSTLRRGNVTHHEYIQVGKGRDVGLNQISLFEAKVACGNGEQTLSRDLYRLGHRFDFFRMMSCYFTTVGFYISSMIVVLTVYAFLYGRLYLSLSGVEEAIVKFAAAKGDSSLKAAMASQSVVQLGLLMTLPMVMEIGLERGFRTALSDLIIMQLQLAPVFFTFSLGTKVHYYGRTILHGGSKYRATGRGFVVKHEKFAENYRMYSRSHFVKGMELMVLLICYRIYGKAAEDSVGYALVMGSTWFLVGSWLFAPFFFNPSGFEWQKIVDDWDDWNKWISSRGGIGVPANKSWESWWEEEQEHLLHSGFFGKFWEIFLSLRYFIYQYGIVYQLNLTKESRMGKQHSIIVYGLSWLVIVAVMIVLKIVSMGRKKFSADFQLMFRLLKLFLFIGSVVIVGMLFHFLKLTVGDIMQSLLAFLPTGWALLQISQVARPLMKTVGMWGSVKALARGYEYIMGVVIFMPVTVLAWFPFVSEFQTRLLFNQAFSRGLQIQRILAGGKKQK

SEQ ID NO: 6 - protein, 1921 aa, Arabidopsis thaliana
  Encoded by locus At3G59100
MEASSSGTAELPRSLSRRAPSRATTMMIDRPNEDASAMDSELVPSSLASIAPILRVANEIEKDNPRVAYLCRFHAFEKAHRMDATSSGRGVRQFKTYLLHRLEKEEEETKPQLAKNDPREIQAYYQNFYEKYIKEGETSRKPEEMARLYQIASVLYDVLKTVVPSPKVDYETRRYAEEVERKRDRYEHYNILPLYAVGTKPAIVELPEVKAAFSAVRNVRNLPRRRIHLPSNTPNEMRKARTKLNDILEWLASEFGFQRGNVANQREHIILLLANADIRKRNDEEYDELKPSTVTELMDKTFKSYYSWCKYLHSTSNLKFPDDCDKQQLQLIYISLYLLIWGEASNVRFMPECICYIFHNMANDVYGILFSNVEAVSGETYETEEVIDEESFLRTVITPIYQVIRNEAKRNKGGTASHSQWRNYDDLNEYFWSKKCFKIGWPLDLKADFFLNSDEITPQDERLNQVTYGKSKPKTNFVEVRTFWNLFRDFDRMWIFLVMAFQAMVIVGWHGSGSLGDIFDKDVFKTVLTIFITSAYLTLLQAALDIILNFNAWKNFKFSQILRYLLKFAVAFMWAVLLPIAYSKSVQRPTGVVKFFSTWTGDWKDQSFYTYAVSFYVLPNILAALLFLVPPFRRAMECSDMRPIKVIMWWAQPKLYVGRGMHEDMFSLFKYTTFWIMLLISKLAFNYYVEILPLITPTKMIMNLHIGHYQWHEFFPHATNNIGVVIAIWAPIVLVYLMDTQIWYAIFSTLFGGIHGAFSHLGEIRTLGMLRSRFESIPIAFSRTLMPSEDAKRKHADDYVDQKNITNFSQVWNEFIYSMRSEDKISDRDRDLLLVPSSSGDVSVIQWPPFLLASKIPIAVDMAKDFKGKEDAELFRKIKSDSYMYYAVIESYETLKKIIYALLEDEADRRVMNQVFLEVDMSMQQQRFIYEFRMSGLPLLSDKLEKFLSILLSDYEDQGTYKSQLINVFQDVIEIITQDLLVNGHEILERARVHSPDIKNEKKEQRFEKINIHLVRDRCWREKVIRLHLLLSVKESAINVPQNLEARRRITFFANSLFMNMPSAPRIRDMLSFSVLTPYYKEDVLYSEEDLNKENEDGISILFYLQKIYPDEWTNYLDRLKDPKLPEKDKSEFLREWVSYRGQTLARTVRGMMYYRQALELQCYQEVAGEQAEFSVFRAMASNDENQKAFLERARALADLKFTYVVSCQVYGNQKKSGDIHNRSCYTNILQLMLKYPSLRVAYVDEREETADAKSPKVFYSVLLKGGDKFDEEIYRIKLPGPPAEIGEGKPENQNHAIIFTRGEALQTIDMNQDNYFEEAFKLRNVLEEFNKERVGRRKPTILGLREHIFTGSVSSLAWFMSNQESSFVTIGQRILANPLRVRFHYGHPDIFDRIFHITRGGVSKASKVINLSEDIFGGFNSTLRGGYVTHHEYIQVGKGRDVGLNPISIFEAKVANGNGEQTLSRDVYRLGHRFDFYRMLSFYFTTIGFYFSSMLTVLTVYAFLYGRMYMVMSGLEKEILRLASPNQLEALEQALATQSIFQLGFLMVLPMVMEIGLEHGFRSAIVDFFIMQLQLASVFFTFQLGTKSHYYGRTILHGGSKYRPTGRGFVVFHAKFAENYRLYSRSHFVKGLELLLLLVVYQIYGHSYRSSNLYLYITVSMWFMVGSWLFAPFIFNPSGFEWQKTVDDWTDWKRWLGDRGGIGIPVEKSWESWWNVEQEHLKHTSIRGRILEITLALRFFIYQYGIVYQLNISQRSKSFLVYGLSWVVLLTSLLVLKMVSMGRRRFGTDFQLMFRILKALLFLGFLSVMTILFVVFKLTLTDLSASVLAFLPTGWAILLIGQVLRSPIKALGVWDSVKELGRAYENIMGLVIFAPIAVLSWFPIVSEFQARLLFNQAFSRGLQISMILAGRKDKATSSHK

SEQ ID NO: 7 - protein, 1958 aa, Arabidopsis thaliana
  Encoded by locus At1G06490
MASTSSGGRGEDGRPPQMQPVRSMSRKMTRAGTMMIEHPNEDERPIDSELVPSSLASIAPILRVANDIDQDNARVAYLCRFHAFEKAHRMDPTSSGRGVRQFKTYLLHKLEEEEEITEHMLAKSDPREIQLYYQTFYENNIQDGEGKKTPEEMAKLYQIATVLYDVLKTVVPQARIDDKTLRYAKEVERKKEQYEHYNILPLYALGAKTAVMELPEIKAAILAVCNVDNLPRPRFHSASANLDEVDRERGRSFNDILEWLALVFGFQRGNVANQREHLILLLANIDVRKRDLENYVEIKPSTVRKLMEKYFKNYNSWCKYLRCDSYLRFPAGCDKQQLSLLYIGLYLLIWGEASNVRFMPECLCYIFHNMANEVHGILFGNVYPVTGDTYEAGAPDEEAFLRNVITPIYQVLRKEVRRNKNGKASHSKWRNYDDLNEYFWDKRCFRLKWPMNFKADFFIHTDEISQVPNQRHDQVSHGKRKPKTNFVEARTFWNLYRSFDRMWMFLVLSLQTMIIVAWHPSGSILAIFTEDVFRNVLTIFITSAFLNLLQATLDLVLSFGAWKSLKFSQIMRYITKFLMAAMWAIMLPITYSKSVQNPTGLIKFFSSWVGSWLHRSLYDYAIALYVLPNILAAVFFLLPPLRRIMERSNMRIVTLIMWWAQPKLYIGRGMHEEMFALFKYTFFWVMLLLSKLAFSYYVEILPLVNPTKLIWDMHVVNYEWHEFFPNATHNIGVIIAIWGPIVLVYFMDTQIWYAIFSTLFGGIYGAFSHLGEIRTLGMLRSRFKVVPSAFCSKLTPLPLGHAKRKHLDETVDEKDIARFSQMWNKFIHTMRDEDLISDRERDLLLVPSSSGDVTVVQWPPFLLASKIPIALDMAKDFKGKEDVDLFKKIKSEYYMHYAVVEAYETVRDIIYGLLQDESDKRIVREICYEVDISIQQHRFLSEFRMTGMPLLSDKLEKFLKILLSDYEEDDYKSQIINVLQDIIEIITQDVMVNGHEILERAHLQSGDIESDKKEQRFEKIDLSLTQNISWREKVVRLLLLLTVKESAINIPQSLEARRRMTFFANSLFMNMPDAPRVRDMLSFSVLTPYYKEDVLYSEEELNKENEDGITILFYLQRIYPEEWSNYCERVNDLKRNLSEKDKAEQLRQWVSYRGQTLSRTVRGMMYYRVALELQCFQEYTEENATNGGYLPSESNEDDRKAFSDRARALADLKFTYVVSCQVYGNQKKSSESRDRSCYNNILQLMLKYPSLRVAYIDEREETVNGKSQKVFYSVLLKGCDKLDEEIYRIKLPGPPTEIGEGKPENQNHAIIFTRGEALQTIDMNQDNYFEECFKMRNVLQEFDEGRRGKRNPTILGLREHIFTGSVSSLAWFMSNQETSFVTIGQRVLANPLRVRFHYGHPDIFDRIFHITRGGISKASKIINLSEDIFAGYNSTLRGGYVTHHEYIQAGKGRDVGMNQISFFEAKVANGNGEQTLSRDVYRLGRRFDFYRMLSFYFTTVGFYFSSMITVLTVYVFLYGRLYLVLSGLEKNILQSASVHESNALEQALAAQSVFQLGFLMVLPMVMEIGLEKGFRTALGDFIIMQLQLASVFFTFQLGTKAHYFGRTILHGGSKYRATGRGFVVFHAKFAENYRLYSRSHFVKGLELVILLVVYQVYGTSYRSSSTYMYITFSMWFLVTSWLFAPFIFNPSGFEWQKTVDDWTDWKRWMGNRGGIGIVLDKSWESWWDIEQEHLKHTNLRGRVLEILLALRFLLYQYGIVYHLNIARRHTTFLVYGLSWAILLSVLLVLKMVSMGRRKFGTDFQVMFRILKALLFLGFLSVMTVLFVVCGLTISDLFASILAFLPTGWAILLIGQALRSVFKGLGFWDSVKELGRAYEYIMGLVIFTPIAVLSWFPFVSEFQTRLLFNQAFSRGLQISMILAGKKDKETPSTKYLGHTEESFGLEHDTNTFNHYYLWT

SEQ ID NO: 8 - protein, 1976 aa, Arabidopsis thaliana
  Encoded by locus At3G14570
MSHEIVPVDPIDVPSTSYSRPILGPREDSPERATEFTRSLTFREHVSSEPFDSERLPATLASEIQRFLRIANLVESEEPRIAYLCRFHAFEIAHHMDRNSTGRGVRQFKTSLLQRLELDEEFTVRRRKEKSDVRELKRVYHAYKEYIIRHGAAFNLDNSQREKLINARRIASVLYEVLKTVTSGAGPQAIADRESIRAKSEFYVPYNILPLDKGGVHQAIMHLPEIKAAVAIVRNTRGLPPPEEFQRHQPFLDLFEFLQYAFGFQNGNVANQREHLILLLSNTIIRQPQKQSSAPKSGDEAVDALMKKFFKNYTNWCKFLGRKNNIRLPYVKQEALQYKTLYIGLYLLIWGEASNLRFMPECLCYIFHHMAYELHGVLTGAVSMITGEKVAPAYGGGHESFLADVVTPIYMVVQKEAEKNKNGTADHSMWRNYDDLNEFFWSLECFEIGWPMRPEHDFFCVESSETSKPGRWRGMLRFRKQTKKTDEEIEDDEELGVLSEEQPKPTSRWLGKTNFVETRSFWQIFRSFDRMWSFFVLSLQALIIMACHDVGSPLQVFNANIFEDVMSIFITSAILKLIKGILDIIFKWKARNTMPINEKKKRLVKLGFAAMWTIILPVLYSHSRRKYICYFTNYKTWLGEWCFSPYMVAVTIYLTGSAIELVLFFVPAISKYIETSNHGIFKTLSWWGQPRLYVGRGMQETQVSQFKYTFFWILVLLTKFAFSYAFEIKPLIEPTRLIMKVGVRNYEWHEIFPEVKSNAAAIVAVWAPIMVVYFMDTQIWYSVYCTIFGGLYGVLHHLGEIRTLGMLRGRFHTLPSAFNASLIPHSTKDEKRRKQRGFFPFNLGRGSDGQKNSMAKFVLVWNQVINSFRTEDLISNKELDLMTMPLSSEVLSGIIRWPIFLLANKFSTALSIAKDFVGKDEVLYRRIRKDEYMYYAVKECYESLKYILQILVVGDLEKKIISGIINEIEESIRQSSLLEEFKMAELPALHDKCIELVQLLVEGSAEQLQVEKSEELHGKLVKALQDIFELVTNDMMVHGDRILDLLQSREGSGEDTGIFMRVIEPQLFESYGEWRCIHFPLPDSASLSEQIQRFLLLLTVKDSAMDIPENLDARRRLSFFATSLFMDMPDAPKVRNMMSFSVLTPHYQEDINYSTNELHSTKSSVSIIFYMQKIFPDEWKNFLERMGCDNLDALKKEGKEEELRNWASFRGQTLSRTVRGMMYCREALKLQAFLDMADDEDILEGYKDVERSNRPLAAQLDALADMKFTYVVSCQMFGAQKSSGDPHAQDILDLMIKYPSLRVAYVEEREEIVLDVPKKVYYSILVKAVNGFDQEIYRVKLPGPPNIGEGKPENQNHAIVFTRGEALQTIDMNQDHYLEEAFKMRNLLQEFLRNRGRRPPTILGLREHIFTGSVSSLAWFMSYQETSFVTIGQRLLANPLRVRFHYGHPDVFDRIFHITRGGISKSSRTINLSEDVFAGYNTTLRRGCITYNEYLQVGKGRDVGLNQISKFEAKVANGNSEQTISRDIYRLGQRFDFFRMLSCYFTTIGFYFSSLISVIGIYIYLYGQLYLVLSGLQKTLILEAKVKNIKSLETALASQSFIQLGLLTGLPMVMEIGLEKGFLIAFQDFILMQLQLAAFFFTFSLGTKTHYFGRTILHGGAKYRPTGRKVVVFHANFSENYRLYSRSHFIKGFELMILLVVYELFKHTSQSNMAYSFITFSVWFMSFTWLCAPFLFNPSGFTWEIIVGDWRDWNRWIKEQGGIGIQQDKSWQSWWNDEQAHLRGSGVGARCLEIILSLRFFVYQYGLVYHLDITQSNTNIIVYALSWVVILATFFTVKAVDLGRQLFSTRKHLVFRFFKVFVFVSILTIIITLANICHLSVKDLLVSCLAFLPTGWGLILIAQAVRPKIEGTSLWEFTQVLARAYDYGMGVVLFAPMAILAWLPIISAFQTRFLFNEAFNRRLQIQPILAGKKKNR

SEQ ID NO: 9 - protein, 1890 aa, Arabidopsis thaliana
  Encoded by locus At3G07160
MSRAESSWERLVNAALRRDRTGGVAGGNQSSIVGYVPSSLSNNRDIDAILRAADEIQDEDPNIARILCEHGYSLAQNLDPNSEGRGVLQFKTGLMSVIKQKLAKREVGTIDRSQDILRLQEFYRLYREKNNVDTLKEEEKQLRESGAFTDELERKTVKRKRVFATLKVLGSVLEQLAKEIPEELKHVIDSDAAMSEDTIAYNIIPLDAPVTTNATTTFPEVQAAVAALKYFPGLPKLPPDFPIPATRTADMLDFLHYIFGFQKDSVSNQREHIVLLLANEQSRLNIPEETEPKLDDAAVRKVFLKSLENYIKWCDYLCIQPAWSNLEAINGDKKLLFLSLYFLIWGEAANIRFLPECLCYIFHHMVREMDEILRQQVARPAESCMPVDSRGSDDGVSFLDHVIAPLYGVVSAEAFNNDNGRAPHSAWRNYDDFNEYFWSLHSFELGWPWRTSSSFFQKPIPRKKLKTGRAKHRGKTSFVEHRTFLHLYHSFHRLWIFLAMMFQALAIIAFNKDDLTSRKTLLQILSLGPTFVVMKFSESVLEVIMMYGAYSTTRRLAVSRIFLRFIWFGLASVFISFLYVKSLKAPNSDSPIVQLYLIVIAIYGGVQFFFSILMRIPTCHNIANKCDRWPVIRFFKWMRQERHYVGRGMYERTSDFIKYLLFWLVVLSAKFSFAYFLQIKPLVGPTRMIVKQNNIPYSWHDFVSRKNYNALTVASLWAPVVAIYLLDIHIFYTIFSAFLGFLLGARDRLGEIRSLEAIHKLFEEFPGAFMRALHVPLTNRTSDTSHQTVDKKNKVDAAHFAPFWNQIIKSLREEDYITDFEMELLLMPKNSGRLELVQWPLFLLSSKILLAKEIAAESNSQEEILERIERDDYMKYAVEEVYHTLKLVLTETLEAEGRLWVERIYEDIQTSLKERNIHHDFQLNKLSLVITRVTALLGILKENETPEHAKGAIKALQDLYDVMRLDILTFNMRGHYETWNLLTQAWNEGRLFTKLKWPKDPELKALVKRLYSLFTIKDSAAHVPRNLEARRRLQFFTNSLFMDVPPPKSVRKMLSFSVFTPYYSEVVLYSMAELTKRNEDGISILFYLQKIYPDEWKNFLARIGRDENALEGDLDNERDILELRFWASYRGQTLARTVRGMMYYRKALMLQSYLERKAGNDATDAEGFELSPEARAQADLKFTYVVTCQIYGRQKEDQKPEAVDIALLMQRNEALRIAYIDVVDSPKEGKSHTEYYSKLVKADISGKDKEIYSIKLPGDPKLGEGKPENQNHAIVFTRGNAIQTIDMNQDNYFEEALKMRNLLEEFDRDHGIRPPTILGVREHVFTGSVSSLASFMSNQETSFVTLGQRVLAKPLKIRMHYGHPDVFDRVFHITRGGISKASRVINISEDIFAGFNTTLRQGNVTHHEYIQVGKGRDVGLNQIALFEGKVAGGNGEQVLSRDVYRLGQLLDFFRMMSFFFTTVGFYLCTMLTVLTVYIFLYGRAYLALSGVGATIRERAILLDDTALSAALNAQFLFQIGVFTAVPMVLGFILEQGFLQAIVSFITMQFQLCTVFFTFSLGTRTHYFGRTILHGGARYQATGRGFVVKHIKFSENYRLYSRSHFVKAMEVILLLVVYLAYGNDEAGAVSYILLTVSSWFLAVSWLFAPYLFNPAGFEWQKVVEDFKEWTNWLFYRGGIGVKGAESWEAWWEEELSHIRTLSGRIMETILSLRFFIFQYGIVYKLKLQGSDTSFAVYGWSWVAFAMIIVLFKVFTFSQKISVNFQLLLRFIQGLSLLMALAGIIVAVVLTPLSVTDIFACVLAFIPTGWGILSIACAWKPVLKRMGMWKSIRSLARLYDALMGMLIFLPVALCSWFPFVSTFQTRMMFNQAFSRGLEISLILAGDNPNSGL

SEQ ID NO: 10 - protein, 1904 aa, Arabidopsis thaliana
  Encoded by locus At2G36850
MARVYSNWDRLVRATLRREQLRNTGQGHERVSSGLAGAVPPSLGRATNIDAILQAADEIQSEDPSVARILCEQAYSMAQNLDPNSDGRGVLQFKTGLMSVIKQKLAKRDGASIDRDRDIERLWEFYKLYKRRHRVDDIQKEEQKWRESGTTFSSNVGEILKMRKVFATLRALIEVLEVLSRDADPNGVGRSIRDELGRIKKADATLSAELTPYNIVPLEAQSMTNAIGVFPEVRGAVQAIRYTEHFPRLPVDFEISGQRDADMFDLLEYIFGFQRDNVRNQREHLVLTLSNAQSQLSIPGQNDPKIDENAVNEVFLKVLDNYIKWCKYLRIRVVYNKLEAIDRDRKLFLVSLYFLIWGEAANVRFLPECICYIFHNMAKELDAKLDHGEAVRADSCLTGTDTGSVSFLERIICPIYETISAETVRNNGGKAAHSEWRNYDDFNEYFWTPACFELSWPMKTESRFLSKPKGRKRTAKSSFVEHRTYLHLFRSFIRLWIFMFIMFQSLTIIAFRNEHLNIETFKILLSAGPTYAIMNFIECLLDVVLMYGAYSMARGMAISRLVIRFLWWGLGSAFVVYYYVKVLDERNKPNQNEFFFHLYILVLGCYAAVRLIFGLLVKLPACHALSEMSDQSFFQFFKWIYQERYFVGRGLFENLSDYCRYVAFWLVVLASKFTFAYFLQIKPLVKPTNTIIHLPPFQYSWHDIVSKSNDHALTIVSLWAPVLAIYLMDIHIWYTLLSAIIGGVMGAKARLGEIRTIEMVHKRFESFPEAFAQNLVSPVVKRVPLGQHASQDGQDMNKAYAAMFSPFWNEIIKSLREEDYLSNREMDLLSIPSNTGSLRLVQWPLFLLCSKILVAIDLAMECKETQEVLWRQICDDEYMAYAVQECYYSVEKILNSMVNDEGRRWVERIFLEISNSIEQGSLAITLNLKKLQLVVSRFTALTGLLIRNETPDLAKGAAKAMFDFYEVVTHDLLSHDLREQLDTWNILARARNEGRLFSRIAWPRDPEIIEQVKRLHLLLTVKDAAANVPKNLEARRRLEFFTNSLFMDMPQARPVAEMVPFSVFTPYYSETVLYSSSELRSENEDGISILFYLQKIFPDEWENFLERIGRSESTGDADLQASSTDALELRFWVSYRGQTLARTVRGMMYYRRALMLQSFLERRGLGVDDASLTNMPRGFESSIEARAQADLKFTYVVSCQIYGQQKQQKKPEATDIGLLLQRYEALRVAFIHSEDVGNGDGGSGGKKEFYSKLVKADIHGKDEEIYSIKLPGDPKLGEGKPENQNHAIVFTRGEAIQTIDMNQDNYLEEAIKMRNLLEEFHGKHGIRRPTILGVREHVFTGSVSSLAWFMSNQETSFVTLGQRVLAYPLKVRMHYGHPDVFDRIFHITRGGISKASRVINISEDIYAGFNSTLRQGNITHHEYIQVGKGRDVGLNQIALFEGKVAGGNGEQVLSRDVYRIGQLFDFFRMMSFYFTTVGFYVCTMMTVLTVYVFLYGRVYLAFSGADRAISRVAKLSGNTALDAALNAQFLVQIGIFTAVPMVMGFILELGLLKAIFSFITMQFQLCSVFFTFSLGTRTHYFGRTILHGGAKYRATGRGFVVQHIKFADNYRLYSRSHFVKAFEVALLLIIYIAYGYTDGGASSFVLLTISSWFLVISWLFAPYIFNPSGFEWQKTVEDFEDWVSWLMYKGGVGVKGELSWESWWEEEQAHIQTLRGRILETILSLRFFMFQYGIVYKLDLTRKNTSLALYGYSWVVLVVIVFLFKLFWYSPRKSSNILLALRFLQGVASITFIALIVVAIAMTDLSIPDMFACVLGFIPTGWALLSLAITWKQVLRVLGLWETVREFGRIYDAAMGMLIFSPIALLSWFPFISTFQSRLLFNQAFSRGLEISIILAGNRANVET

SEQ ID NO: 11 - protein, 1768 aa, Arabidopsis thaliana
  Encoded by locus At4G04970
MRRQRPSVATARDAPSLEVYNIIPIHDFLTEHPSLRYPEVRAAAAALRIVGDLPKPPFADFTPRMDLMDWLGLLFGFQIDNVRNQRENLVLHLANSQMRLQPPPRHPDGLDPTVLRRFRKKLLRNYTNWCSFLGVRCHVTSPIQSRHQTNAVLNLRRELLYVALYLLIWGESANLRFMPECLCYIFHHMAMELNKVLAGEFDDMTGMPYWPSFSGDCAFLKSVVMPIYKTVKTEVESSNNGTKPHSAWRNYDDINEYFWSKRALKSLKWPLDYTSNFFDTTPKSSRVGKTGFVEQRSFWNVYRSFDRLWILLLLYLQAAIIVATSDVKFPWQDRDVEVALLTVFISWAGLRLLQSVLDASTQYSLVSRETYWLFIRLTLKFVVAVAWTVLFSVFYARIWSQKNKDGVWSRAANERVVTFLKVVFVYVIPELLALVLFIVPCIRNWVEELNLGVVYFLTWWFYSKTFVGRGMREGLVDNVKYTLFWIIVLATKFIFSYFLQIRPLIAPTRALLNLKDATYNWHEFFGSTHRIAVGMLWLPVILVYLMDLQIWYSIYSSLVGATIGLFSHLGEIRNIDQLRLRFQFFSSAMQFNLKPEEHLLSPKATMLKKARDAIHRLKLRYGIGQPFNKIESSQVEATWFALIWNEIILTFREEDLISDREVELLELPPNCWNIRVIRWPCFLLCNELLLALSQANELCDAPDHWLWSKICSSEYRRCAVMEAFDSIKFVILKIVKNGTEEESILNRLFMEIDENVENEKITEVYKLTVLLRIHEKLISLLERLMDPEKKVFRIVNILQALYELCAWEFPKTRRSTPQLRQLGLAPISLEADTELLFVNAINLPPLDDVVFYRQIRRVHTILTSRDPMHNVPKNIEARERLAFFSNSLFMTMPQAPSVEKMMAFSVLTPYYDEEVMYRQEMLRAENEDGISTLFYLQRIYEDEWVNFLERMRREGAENENDIWSKKVRDLRLWASYRGQTLSRTVRGMMYYYSALKKLAFLDSASEMDIRMGTQIAPEARRSYYTNDGGDNTLQPTPSQEISRMASGITHLLKGSEYGSAMMKFTYVVACQVYGQHKARGDHRAEEILFLMKNHDALRIAYVDEVDLGRGEVEYYSVLVKFDQQLQREVEIYRIRLPGPLKLGEGKPENQNHALIFTRGDAIQTIDMNQDNHFEEALKMRNLLESFKTYYGIRKPTILGVREKVFTGSVSSLAWFMSAQETSFVTLGQRVLANPLKVRMHYGHPDVFDRFWFVPRGGISKASRVINISEDIFAGFNCTLRGGNVTHHEYIQVGKGRDVGLNQISMFEAKVASGNGEQALSRDVYRLGHRLDFFRMLSFFYTTVGYYFNTMLIVFTVYAFLWGRLYLALSGVEKIAKDRSSSNEALGAILNQQFIIQLGLFTALPMILENSLERGFLPAVWDFITMQLQLASFFYTFSMGTRTHYFGRTILHGGAKYRATGRGFVVEHKKFAENYRLYARTHFIKAIELAIILLVYAAYSPLAKSSFVYILMTISSWFLITSWIISPFLFNPSGFDWLKTVNDFDDFIAWLWSRGGLFTKADQSWFTWWNEEQEHLKTTGVWGKLLEIILDLRFFFFQYSIVYHLRIAENRTSIGVYLISWGCIIGIVAIYITTIYAQKRYSVKEHIKYRFIQFLVILLTVLVVVMMLQFTKLTVVDLLISLLAFVPTGWGLISIAQVLKPFLLSTVVWDTVISVARFYDLFFGLIVMAPVALLSWLPGFQNMQTRILFNEAFSRGLQISIILAGKKST

SEQ ID NO: 12 - protein, 1780 aa, Arabidopsis thaliana
  Encoded by locus At4G03550
MSLRHRTVPPQTGRPLAAEAVGIEEEPYNIIPVNNLLADHPSLRFPEVRAAAAALKTVGDLRRPPYVQWRSHYDLLDWLALFFGFQKDNVRNQREHMVLHLANAQMRLSPPPDNIDSLDSAVVRRFRRKLLANYSSWCSYLGKKSNIWISDRNPDSRRELLYVGLYLLIWGEAANLRFMPECICYIFHNMASELNKILEDCLDENTGQPYLPSLSGENAFLTGVVKPIYDTIQAEIDESKNGTVAHCKWRNYDDINEYFWTDRCFSKLKWPLDLGSNFFKSRGKSVGKTGFVERRTFFYLYRSFDRLWVMLALFLQAAIIVAWEEKPDTSSVTRQLWNALKARDVQVRLLTVFLTWSGMRLLQAVLDAASQYPLVSRETKRHFFRMLMKVIAAAVWIVAFTVLYTNIWKQKRQDRQWSNAATTKIYQFLYAVGAFLVPEILALALFIIPWMRNFLEETNWKIFFALTWWFQGKSFVGRGLREGLVDNIKYSTFWIFVLATKFTFSYFLQVKPMIKPSKLLWNLKDVDYEWHQFYGDSNRFSVALLWLPVVLIYLMDIQIWYAIYSSIVGAVVGLFDHLGEIRDMGQLRLRFQFFASAIQFNLMPEEQLLNARGFGNKFKDGIHRLKLRYGFGRPFKKLESNQVEANKFALIWNEIILAFREEDIVSDREVELLELPKNSWDVTVIRWPCFLLCNELLLALSQARELIDAPDKWLWHKICKNEYRRCAVVEAYDSIKHLLLSIIKVDTEEHSIITVFFQIINQSIQSEQFTKTFRVDLLPKIYETLQKLVGLVNDEETDSGRVVNVLQSLYEIATRQFFIEKKTTEQLSNEGLTPRDPASKLLFQNAIRLPDASNEDFYRQVRRLHTILTSRDSMHSVPVNLEARRRIAFFSNSLFMNMPHAPQVEKMMAFSVLTPYYSEEVVYSKEQLRNETEDGISTLYYLQTIYADEWKNFKERMHREGIKTDSELWTTKLRDLRLWASYRGQTLARTVRGMMYYYRALKMLAFLDSASEMDIREGAQELGSVRNLQGELGGQSDGFVSENDRSSLSRASSSVSTLYKGHEYGTALMKFTYVVACQIYGSQKAKKEPQAEEILYLMKQNEALRIAYVDEVPAGRGETDYYSVLVKYDHQLEKEVEIFRVKLPGPVKLGEGKPENQNHAMIFTRGDAVQTIDMNQDSYFEEALKMRNLLQEYNHYHGIRKPTILGVREHIFTGSVSSLAWFMSAQETSFVTLGQRVLANPLKVRMHYGHPDVFDRFWFLSRGGISKASRVINISEDIFAGFNCTLRGGNVTHHEYIQVGKGRDVGLNQISMFEAKVASGNGEQVLSRDVYRLGHRLDFFRMLSFFYTTVGFFFNTMMVILTVYAFLWGRVYLALSGVEKSALADSTDTNAALGVILNQQFIIQLGLFTALPMIVEWSLEEGFLLAIWNFIRMQIQLSAVFYTFSMGTRAHYFGRTILHGGAKYRATGRGFVVEHKGFTENYRLYARSHFVKAIELGLILIVYASHSPIAKDSLIYIAMTITSWFLVISWIMAPFVFNPSGFDWLKTVYDFEDFMNWIWYQGRISTKSEQSWEKWWYEEQDHLRNTGKAGLFVEIILVLRFFFFQYGIVYQLKIANGSTSLFVYLFSWIYIFAIFVLFLVIQYARDKYSAKAHIRYRLVQFLLIVLAILVIVALLEFTHFSFIDIFTSLLAFIPTGWGILLIAQTQRKWLKNYTIFWNAVVSVARMYDILFGILIMVPVAFLSWMPGFQSMQTRILFNEAFSRGLRIMQIVTGKKSKGDV

SEQ ID NO: 13 - protein, 1902 aa, Arabidopsis lyrata subsp. lyrata
MSATRGGPEQGPSQPQQRRIVRTQTAGNLGESFDSEVVPSSLVEIAPILRVANEVESSNPRVAYLCRFYAFEKAHRLDPTSSGRGVRQFKTALLQRLEREHDPTLMGRVKKSDAREMQSFYQHYYKKYIQALHNAADKADRAQLTKAYQTANVLFEVLKAVNLTQSIEVDREILEAQDKVAEKTQLYVPYNILPLDPDSANQAIMRYPEIQAAVLALRNTRGLPWPEGHKKKKDEDMLDWLQEMFGFQKDNVANQREHLILLLANVHIRQFPKPDQQPKLDDQALTEVMKKLFKNYKKWCKYLGRKSSLWLPTIQQEMQQRKLLYMALYLLIWGEAANLRFMPECLCYIYHHMAFELYGMLAGNVSPMTGENVKPAYGGEEDAFLRKVVTPIYEVIQMEAQRSKKGKSKHSQWRNYDDLNEYFWSVDCFRLGWPMRADADFFCLPVAVPNTEKDGDNSKPTVARDRWVGKVNFVEIRSFWHVFRSFDRMWSFYILCLQAMIIMAWDGGQPSSVFGADVFKKVLSVFITAAIMKLGQAVLDVILNFKAHQSMTLHVKLRYILKVLSAAAWVIILPVTYAYSWKDPPAFARTIKSWFGNAMHSPSLFIIAVVFYLSPNMLAETNEKHPMCFFADATIISYIFYTLQPRLYVGRGMHESAFSLFKYTMFWVLLIATKLAFSYYIEIKPLVAPTQAIMKARVTNFQWHEFFPRAKNNIGVVIALWAPIILVYFMDSQIWYAIFSTLFGGIYGAFRRLGEIRTLGMLRSRFESLPGAFNDRLIPDGKNQQKKKGIRATLSHNFTEDKVPVNKEKEAARFAQLWNTIISSFREEDLISDREMDLLLVPYWADRDLDLIQWPPFLLASKIPIALDMAKDSNGKDRELKKRIESDTYMKCAVRECYASFKNIIKFVVQGNREKEVIEIIFAEVDKHIDTGDLIQEYKMSALPSLYDHFVKLIKYLVNVLLVLDNKEEDRDHVVILFQDMLEVVTRDIMMEDYNISRLATFYRNLGAIRFPIEPVTEAWKEKIKRIYLLLTTKESAMDVPSNLEARRRISFFSNSLFMDMPMAPKVRNMLSFSVLTPYYTEEVLFSLRDLETPNEDGVSILFYLQKIFPDEWNNFLERVKCLSEEELKESDELEEELRLWASYRGQTLTRTVRGMMYYRKALELQAFLDMAMHEDLMEGYKAVELNSENNSRGERSLWAQCQAVADMKFTYVVSCQQYGIHKRSGDPRAQDILRLMTRYPSLRVAYIDEVEEPVKDKSKKGNQKVYYSVLVKVPKSTDHSSLAQNLDQVIYRIRLPGPAILGEGKPENQNHAIIFSRGEGLQTIDMNQDNYMEEALKMRNLLQEFLTKHDGVRHPSILGLREHIFTGSVSSLAWFMSNQETSFVTIGQRLLANPLRVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMMSCYFTTVGFYFSTLITVLTVYIFLYGRLYLVLSGLEQGLSTQKGIRDNTPLQIALASQSFVQIGFLMALPMLMEIGLERGFRTALSEFVLMQLQLAPVFFTFSLGTKTHYYGRTLLHGGAKYRSTGRGFVVFHAKFADNYRLYSRSHFVKGLEMMLLLVVYQIFGSAYRGVLAYLLITISMWFMVGTWLFAPFLFNPSGFEWQKIVDDWTDWNKWINNIGGIGVPAEKSWESWWEEEQEHLRYSGKRGLWSIMAGDFLDIVCDEDCFGWKAEIQREFSADVPVDKGANIHDVYRNHCDIDHTGSHDDTRHNCVYPCLYAHRLGDALACKPVVHRAGFWGSVRTLARGYEIVMGLLLFTPVAFLAWFPFVSEFQTRMLFNQAFSRGLQISRILGGHRKDRSSRNKE

SEQ ID NO: 14 - protein, 1974 aa, Ricinus communis
MSSSSRVGPDQGTPQPPRRIMRTQTAGNLGESIFDSEVVPSSLVEIAPILRVANEVESSNPRVAYLCRFYAFEKAHRLDPTSSGRGVRQFKTALLQRLERENDPTLMGRVKKSDAREMQSFYQHYYKKYIQALQNAADKADRAQLTKAYQTANVLFEVLKAVNMTQSIEVDREILEAQDKVAEKTQIYVPYNILPLDPDSANQAIMRYPEIQAAVYALRNTRGLPWPKDYKKKKDEDILDWLQAMFGFQKDNVANQREHLILLLANVHIRQFPKPDQQPKLDERALTEVMKKLFKNYKKWCKYLDRKSSLWLPTIQQEVQQRKLLYMGLYLLIWGEAANLRFMPECLCYIYHHMAFELYGMLAGNVSLSTGENVKPAYGGANEAFLRLVVTPIYDVIAKESERSKMGKSKHSQWRNYDDLNEYFWSVDCFRLGWPMRDDADFFHLPAEHYRYEKNGENSKPAFRDRWVGKVNFVEIRTFWHVFRSFDRMWSFFILCLQAMIIVAWNGSGEPNAVFNGDVFKKVLSVFITAAILKLGQAVLDVILSWKARQIMSFHVKLRYILKVVSAAAWVVILPVTYAYTWENPPGFAQTIKSWFGNNSSSPSLFILAVVIYLSPNMLAAVLFLFPILRRFLERSNYKIVMLMMWWSQPRLYVGRGMHESALSLFKYTMFWVLLIMTKLAFSYYIEIKPLVRPTKDVMNVHIITFQWHEFFPRARNNIGAVIALWAPIILVYFMDTQIWYAIFSTLFGGIYGAFRRLGEIRTLGMLRSRFQSIPGAFNACLIPEEKSEPKKKGLKATLARNFAVITSNKEDGAARFAQLWNKIISSFREEDLISNREMDLLLVPYWADEDLGLIQWPPFLLASKIPIALDMAKDSNGKDKELKKRIEAENYMSCAVRECYASFRNIIKFLVQGKRETEVIDFIFSEVEKHIDEGTLISEYKMSALPSLYDQFVRLIKHLLDNKQEDRDQVVILFQDMLEVVTRDIMMEDHISSLVDSMHGGSGHEEMILIDQQYQLFASSGAIKFPIDPATEAWKEKIKRLYLLLTTKESAMDVPSNLEARRRISFFSNSLFMDMPDAPKVRNMLSFSVLTPYYTEEVLFSLRDLEVPNEDGVSILFYLQKIFPDEWNNFLERVNCSSEEELKGSDELEEELRLWASYRGQTLTRTVRGMMYYRKALELQAFLDMARHEDLMEGYKAMELNTEDQSKGERSMLAQCQAVADMKFTYVVSCQKYGIHKRSGDPRAQDILKLMTTYPSLRVAYIDEVEVTSQDKSKKNNRKEYFSALVKAASPKSIDPSEPVQNLDEVIYRIKLPGPAILGEGKPENQNHAIIFTRGEGLQTIDMNQDNYMEEALKMRNLLQEFLKKHDGVRHPTILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMLSCYFTTVGFYFSTLMTVLTVYVFLYGRLYLVLSGLEKGLISQKAIRDNKPLQVALASQSFVQIGFLMALPMLMEIGLERGFRTALSEFILMQLQLAPVFFTFSLGTKTHYYGRTLLHGGAKYRPTGRGFVVFHAKFAENYRLYSRSHFVKGIEMMILLVVYQIFGQPYRSAVAYVLITISMWFMVGTWLFAPFLFNPSGFEWQKIVDDWTDWNKWISNRGGIGVPPEKSWESWWEEEQEHLRHSGKRGIVAEILLSLRFFIYQYGLVYHLKITKEHKSFLVYGISWLVIFVILFVMKTVSVGRRKFSANFQLVFRLIKGMIFLTFVSILVTLIALPHMTVQDIVVCILAFMPTGWGMLLIAQACKPLVHRMGFWGSVRTLARGYEIVMGLLLFTPVAFLAWFPFVSEFQTRMLFNQAFSRGLQISRILGGQRKDRSSRSKECRGIVSMMDEMGRNFDYWN

SEQ ID NO: 15 - protein, 1964 aa, Vitis vinifera
MASRSGSDQPQPQPQQRRITRTQTAGNLGESIFDSEVVPSSLVEIAPILRVANEVESSHPRVAYLCRFYAFEKAHRLDPTSSGRGVRQFKTALLQRLERENDPTLMGRVKKSDAREMQSFYQHYYKKYIQALQNAADKADRAQLTKAYQTANVLFEVLKAVNHTQAIEVDREILEAQNQVAEKTEIYVPYNILPLDPDSANQAIMRYPEIQAAVYALRNTRGLPWPRDYKKKNDEDILDWLQAMFGFQKDNVANQREHLILLLANVHIRQFPKPDQQPKLDERALTEVMKKLFKNYKKWCKYLDRKSSLWLPTIQQEVQQRKLLYMGLYLLIWGEAANLRFMPECLSYIYHHMAFELYGMLAGNVSPMTGEHVKPAYGGEEEAFLKKVVTPIYEVIAKEADRSKRGKSKHSQWRNYDDLNEYFWSVDCFRLGWPMRADADFFYLPIEETHNERNGDGKPTARDRWMGKVNFVEIRSFWHIFRSFDRMWSFFILCLQAMIIVAWNGSGEPSSIFSGDVFKKVLSVFITAAILKLGQAVLDVILSWKARESMSFYVKLRYILKVVLAAAWVIILPVTYAYTWENPPGFAQTIKSWFGNSSHSPSLFILAVVVYLSPNMLAAVLFLFPFIRRFLERSNYKIVMLMMWWSQPRLYVGRGMHESTFSLFKYTMFWVLLIITKLAFSYYIEIKPLVGPTKAIMSVKITNFQWHEFFPRAKNNIGVVVALWAPIILVYFMDTQIWYAIFSTLFGGIYGAFRRLGEIRTLGMLRSRFQSLPGAFNACLIPEEKSEPKKKGLKATFSRNFAQIPSNKEKEAARFAQLWNKIITSFRAEDLISDREMDLLLVPYWADRDLELIQWPPFLLASKIPIALDMAKDSNGKDKELKKRIENDNYMSCAVRECYASFRNIIKFLVRGDREKEVIECIFSEVDRHIEAGDLIREFKMSALPSLYDHFVKLIGYLLENKQEDRDQVVILFQDMLEVVTRDIMMEDNVSSLVDTGGPGYEGMTSLEQHSQLFASSGAIKFPILPSSEAWKEKIKRLYLLLTVKESAMDVPSNLEARRRISFFSNSLFMDMPIAPKVRNMLSFSVLTPYYTEEVLFSLHDLEVPNEDGVSILFYLQKIFPDEWNNFLERMGCNNEEELLEGDKLEELRLWASYRGQTLSKTVRGMMYYRKALELQAFLDMAKDEDLMEGYKAIELNTEDHSKGERTLWAQCQAVADMKFTYVVSCQKYGIHKRSGDHRAQDILKLMTTYPSLRVAYIDEVEEPSKDRKKINQKAYYSVLVKAAPPNINSSEPVQNLDQIIYKIKLPGPAILGEGKPENQNHAIIFTRGEGLQAIDMNQDNYMEEALKMRNLLQEFLTKHDGVRFPTILGLREHIFTGSVSSLAWFMSNQETSFVTIGQRLLANPLKVRFHYGHPDVFDRLFHLTRGGISKASKIINLSEDIFAGFNSTLREGNVTHHEYIQVGKGRDVGLNQISMFEAKIANGNGEQTLSRDIYRLGHRFDFFRMLSCYFTTIGFYFSTLITVLTVYIFLYGRLYLVLSGLEEGLSTQAAFRDNKPLQVALASQSFVQIGFLMALPMLMEIGLERGFRTALSEFILMQLQLAPVFFTFSLGTKTHYYGRTLLHGGAKYRPTGRGFVVFHAKFAENYRLYSRSHFVKGIELMILLLVYQIFGHTYRSAVAYVLITISMWFMVGTWLFAPFLFNPSGFEWQKIVDDWTDWNKWVSNRGGIGVTAEKSWESWWEEEQEHLRHSGKRGIIAEILLSLRFFIYQYGLVYHLNLTKNTKSFLVYGISWLVICIILFVMKTVSVGRRKFSANFQLMFRLIKGLIFLTFVSILVTLIALPHMTLQDIIVCILAFMPTGWGLLLIAQACKPVVERAGFWASVRTLARGYEIIMGLLLFTPVAFLAWFPFVSEFQTRMLFNQAFSRGLQISRILGGHRKDRSSRNKDSSLLAFHSTKGDRSCE

SEQ ID NO: 16 - protein, 1940 aa, Populus trichocarpa
MGMDQAAGGPLATPPQTQRRLTRTQTAGNLGESIFDSEVVPSSLVEIAPILRVANEVESSNPRVAYLCRFYAFEKAHRLDPTSSGRGVRQFKTALLQRLERENDPTLMGRVKKSDAREMQSFYQHYYKKYIQALHNAADKADRAQLTKAYQTANVLFEVLKAVNTTQSIEVDREILEAQDKVAEKTQIYLPYNILPLDPDSANQAIMRYPEIQAAVVALRNTRGLPWPKDYKKKNDEDVLDWLQAMFGFQKDNVANQREHLILLLANVHIRQFPKPDQQPKLDERALTEVMKKLFKNYKKWCKYLDRKSSLWLPTIQQEVQQRKLLYMGLYLLIWGEAANLRFMPECICYIYHHMAFELYGMLAGNVSPMTGENVKPAYGGEEEAFLSKVVTPIYNMIAKEAERSKKGKSKHSQWRNYDDLNEYFWSVDCFRLGWPMRADADFFCLSDHHHFEKNGDNKPAYRDRWVGKVNFVEIRSFLHVFRSFDRMWSFFILCLQAMITVAWHGSGQPSVIFSGDVFKKVLSVFITAAILKLGQAILDVILNWKARQIMSFHVKLRFILKVVSAAAWVVVLPVTYAYTWDDKPPGFAQTIKGWFGNGFSSPSLFILAVVIYLAPNMLAAVLFLFPFIRRFLERSNYRIVMLMMWWSQPRLYVGRGMHESTISLFKYTMFWVLLIITKLTFSYYIEIRPLVVPTKAIMSVHITTFQWHEFFPRAKNNIGVVIALWAPIILVYFMDSQIWYAIFSTFFGGIYGAFRRLGEIRTLGMLRSRFQSLPGAFNACLIPGDKSEPKKKGFKATLSRKFAEIPSNKEKEAARFAQLWNKIISSFREEDLISNKEMDLLLVPYWADRDLDLIQWPPFLLASKIPIALDMAKDSNGKDKELKKRIEADNYMSCAVRECYASFKNIILFLVQGKREKERGDLISEYKMSALPFLYDHFVKLIKYLLANKPEDRDQVVILFQDMLEVVTRDIMMEDHISNLVDSIHGGSGHEGMTLHERQYQLFASSGAIKFPIEPVTEAWKEKIKRLFLLLTTKESAMDVPSNLEARRRISFFSNSLFMDMPTAPKVRNMLSFSVLTPYYTEDVLFSLLDLEVPNEDGVSILFYLQKIFPDEWNNFLERVDCSSEEELKGRDNLDEELRLWASYRGQTLTRTVRGMMYYRHALELQAFLDMAGDEDLMEGYKAIELSTDDQSKGGRSLLAQCQAVADMKFTYVVSCQKYGIHKRSGDPRAQDILRLMTTYPSLRVAYIDEVEETNPDRSKVIQKVYYSSLVKAALPKSIDSSEPVQNLDQVIYRIKLPGPAILGEGKPENQNHAIIFTRGEGLQTIDMNQDNYMEEALKMRNLLQEFLKKPDGVRNPSILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMLSCYFTTVGFYFSTLITVLTVYVFLYGRLYLVLSGLEEGLSTQKAIRDNKPLQVALASQSFVQIGFLMALPMLMEIGLERGFRTALSEFILMQLQLAPVFFTFSLGTKTHYYGRTLLHGGAKYRPTGRGFVVFHAKFADNYRLYSRSHFVKGIEMMILLVVYQIFGQPYRSAVAYLLITISMWFMVGTWLFAPFLFNPSGFEWQKIVDDWTDWNKWISNRGGIGVPSEKSWESWWEEEQEHLRHSGKRGILAEILLSLRFFIYQYGLVYHLTITKKTKSFLVYGVSWLVIFLILFVMKTVSVGRRKFSANFQLAFRLIKGMIFLTFISILVTLIALPHMTVQDIFVCILAFMPTGWGMLLIAQACKPIVQRAGFWGSVQTLARGYEIVMGLLLFTPVAFLAWFPFVSEFQTRMLFNQAFSRGLQISRILGGPRKDRSSRNKE

SEQ ID NO: 17 - protein, 1961 aa, Populus trichocarpa
MGMDQAAAGVGTGATPPPTQRRITRTQTAGNLGESVFDSEIVPSSLFEIAPILRVANEVETSNPRVAYLCRFYAFEKAHRLDPTSSGRGVRQFKTALLQRLERENDPTLMGRVKKSDAREMQGFYQHYYKKYIQALHNAADKADRAQLTKAYQTANVLFEVLKAVNMTQSIEVDREILEAQDEVAEKTQIYLPYNILPLDPDSADQAIMRYPEIQAAVLALRNTRGLPWPKDYKKKTDEDVLDWLQAMFGFQKDNVANQREHLILLLANVHMRQFVKPDQQPKLDERALTEVMKKLFKNYKKWCKYLDRKSSLWLPTIQQEVQQRKLLYMGLYLLIWGEAANLRFMPECLCYIYHHMAFELYGMLAGNVSPMTGENVKPAYGGEEEAFLRKVVTPIYNVIAKEAERSKKGKSKHSQWRNYDDINEYFWSVDCFRLGWPMRADADFFCLSSEQLRFVQNGDDKPAYRDRWVGKVNFVEIRTFWHVFRSFDRMWSFFILCLQAMIIVAWNGSGKLSAIFSGDVFKKVLSVFITAAILKLGQAILDVILSWKARQIMSFHVKLRYILKVVSAAAWVVVLPVTYAYTWKENPPGFAQTIKGWFGNSSSSSSLFVLAVVIYLAPNMLAALLFLFPFIRRFLERSDYRIVMFMMWWSQPRLYVGRGMHESTISLFKYTMFWVLLIVTKLAFSYYIEIKPLVDPTKAIMDVHITAFQWHEFFPQAKNNIGVVIALWAPIILVYFMDAQIWYAIFSTLFGGIYGAFRRLGEIRTLGMLRSRFQSLPGAFNACLIPDEKSERKKKSLKARFSRNFNENPPNKDTEAPRFAQLWNKIISSFREEDLISNREMDLLLVPYWADRDLGVLGLTQWPPFLLASKIPIALDMAKDSNGKDKELKKRIEADNYMSCAVCECYASFKNIIKFLVQGRPETEVIDSIFVDVENHIKQGDLIKDYKMSALPLLYDHLVKLIKCLVDNRPEDRDQVVILFQDMLEVVTRDIMEDQISSLVDSIPDGSGYEGMKPLEQQYQLFASAGAIKFPIEPETEAWKEKIKRLYLLLTTKESAMDVPSNLEARRRISFFSNSLFMDMPAAPKVRNMLSFSVLTPYYTEEVLFSLHDLEEPNEDGVSILFYLQKIFPDEWNHFLERVNCTGEEELKERDDLEELRLWASYRGQTLTRTVRGMMYYRHALELQAFLDIAKHEDLMEGYKAIELNTEDQSKGGSSLLAECQAVADMKFTYVVSCQQYGIHKRSGDLRAQDILRLMTTYPSLRVAYIDEVEETNPDKSKKVIQKVYYSSLVKAALPKSIDSSEPVQNLDQVIYRIKLPGPAILGEGKPENQNHAIIFTRGEGLQTIDMNQDNYMEEALKMRNLLQEFLKKPDGVRHPSILGLREHIFTGSVSSLAWFMSNQETSFVTIGQRLLANPLKVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMLSCYFTTVGFYFSTLITVLTVYVFLYGRLYLVLSGLEEGLSTQKAIRDNKPLQVALASQSFVQIGFLMALPMLMEIGLERGFRTALSEFLLMQLQLAPVFFTFSLGTKTHYYGRTLLHGGAKYRSTGRGFVVFHAKFADNYRLYSRSHFVKGIEMMILLVVYQIFGQPYRSAVAYVLITISMWFMVGTWLFAPFLFNPSGFEWQKIVDDWSDWNKWISNRGGIGVPPEKSWESWWEEEQEHLRHSGKRGIVAEILLSLRFFIYQYGLVYHLTITKKMKDRSFLIYGISWLVILLILFVMKTVSVGRRKFSANFQLVFRLIKGMIFLTFVSILVTLIALPHMTVQDVIVCILAFMPTGWGMLLIAQACKPVVQRAGFWGSVRTLARGYEIVMGLLLFTPVAFLAWFPFVSEFQTRMLFNQAFSRGLQISRILGGHRKDRSSRNKE

SEQ ID NO: 18 - protein, 1946 aa, Vitis vinifera
MAYRRGSEQQPPRRIMRTQTAGNLGEAMMDSEVVPSSLVEIAPILRVANEVESSNPRVAYLCRFYAFEKAHRLDPTSSGRGVRQFKTALLQRLERENEITLAGRAKSDAREMQSFYQHYYKKYIQALQKAADKADRAQLTKAYQTAAVLFEVLKAVNLTESVEVADEILQAHTEVKEKTELYAPYNILPLDPDSANQAIMRFPEIKVSVAALRNTRGLPWPKGYKRKADEDILDWLQAMFGFQKDNVANQREHLILLLANGHIRQFPKPDQQPKLDDRAVTEVMKKLFKNYKKWCNYLGRKSSLWLPTIQQDVQQRKLLYMGLYLLIWGEAANLRFMPECLCYIYHHMAFEVYGSLSGSVSPMTGENVKPTYGGEEEAFLKKVVTPIYETIAKEAERSKGGKSKHSQWRNYDDLNEYFWSMDCFRLGWPMRADADFFRLPPKQFNSSEDEEKKPAARRWMGKINFVEIRSFCHIFRSFYRMWSFYILSLQAMIIISWNGSGKLSSILDGEVFKKVMSIFITAAILKLTQAILDVILSWKARKSMPFYVKLRYLLKVVSAAAWVIILPVTYAYSWKNPPGFAQTIRKWFGNSPTSSSLFILFVFIYLSPNMLSALLFLFPFIRRYLERSDYKIVMLMMWWSQPRLYVGRGMHESTLSLFKYTMFWVLLMMSKLAFSYFVEIKPLVGPTKAIMDVHITKYQWHEFFPQAKKNVGVVASLWAPVVLVYFMDTQIWYAIFSTIFGGLYGAFRRLGEIRTLELLRSRFRSLPGAFNFRLIPVEENEKTKNRGLLATLSRKFDEIPSDKSNPAAKFAQLWNKIISSFREEDLINDSEMSLLLLPYWDDPDLDLIQWPPFLLASKIPIAVDMAKDINGKESKVSELKKRLQQDEYMQCAVRECYASFKNIINFLVQGEREMLVINDIFNKVDDHINKDNLMELNMGALPDLHELFVNLIVFLKDNNKEDKDKVVILLLDMLEVVTRDIMDDPIPSLLDSTHGGSYGKHEGMMPLDQQHQFFGELNFPVPDSEAWKEKIRRLNLLLTVKESAMDVPSNIDAKRRISFFSNSLFMDMPPAPKVRNMLSFSVLTPYYKEEVLFSLKSLEEPNEDGVSIIFYLQKIFPDEWKNFLERVDRNSEEDLRGHEDLEEKLRLWASYRGQTLTRTVRGMMYYRKALELQTFLDMAQVEDLKKGYKAAELNSEEHSKSERSLWSQCQAVADMKFTYVVSCQQYGIDKRAGDPRAKDILRLMTTYPSLRVAYVDEVEKTSKDKSKKTEEKVYYSALAKAALPKSIDSSDPVQNLDQDIYRIKLPGPAILGEGKPENQNHAIIFTRGECLQTIDMNQDNYMEEAFKMRNLLQEFLKKHDGVRNPTILGLREHIFTGSVSSLAWFMSNQENSFVTIGQRLLANPLRVRFHYGHPDVFDRLFHLTRGGVSKASKVINLSEDIFAGINSTLREGSVTHHEYIQVGKGRDVGLNQISMFEAKIANGNGEQTLSRDIYRLGHRFDFFRMMSCYFTTIGFYFSTLLTVLTVYVFLYGRLYLVLSGLEKELSNKPAIRDNKALQVALASQSFVQIGFLMALPMIVEIGLEKGFRKALTDFIIMQLQLAPVFFTFSLGTKTHYYGRTLLHGGAEYRGTGRGFVVFHARFAENYRLYSRSHFVKGMELMILLLVYHIFGSSYKGTVAYILITISMWLMVGTWLFAPFLFNPSGFEWQKIVDDWTDWNKWISNRGGIGVSAEKSWESWWEKEQEHLHHSGKRGIIAEILLALRFFIYQYGLVYHLSITKSKSFLVYGISWVVIFGILFVMKALSVGRRRFSADFQLVFRLIKGLIFLTFFAVLIILIVVPHMTFGDILVCFLAILPTGWGLLLIAQACKPLVVRAGIWKSVRTLARSYELFMGLILFIPVAFLAWFPFVSEFQTRMLFNQAFSRGLQISRILGGQRKDNSSNNKD

SEQ ID NO: 19 - protein, 1969 aa, Oryza sativa Japonica Group
MASSSSGRRVGGPRGGGESSPSPAAGAGAAASGGRRILRTQTAGNLGESIFDSEVVPSSLVEIAPILRVANEVEGSNPRVAYLCRFYAFEKAHRLDPTSSGRGVRQFKTALLQRLERENDPTLKGRVKQSDAREMQSFYQHYYKKYIQALQNAADKADRAQLTKAYQTAAVLFEVLKAVNVSQKIEVDQAILETHNQVEEKKKLYLPYNILPLDPDSANQAIMRYPEIQAAFHALRNTRGLPWPKDHEKKPDADLLGWLQAMFGFQKDNVSNQREHLILLLANVHIRQIPKPDQQPKLDDRALDTVMKKLFKNYKRWCKYLGRKSSLWLPTIQQEVQQRKLLYMGLYLLIWGEAANLRFMPECLCYIYHHMAFELYGMLAGNVSPTTGENVKPAYGGDEEAFLKKVVTPIYKVIEKEAERSESSERSERSKTTKSKHSHWRNYDDLNEYFWSRDCFRLGWPMRADADFFKTPDYAYHDEVSGENRRVGSGQWMGKVNFVEIRSFWHIFRSFDRMWSFLILSLQAMIIIAWNGGTPSDIFDAGVFKQVLSIFITAAILKLGQAILDIILSWKARRSMSLAGKLRYILKLISAAAWVVILPVTYAYTWENPTGLARTIKSWLGDGQNQPSLYILAVVIYLAPNMLSAVLFLFPVLRRALERSNLKVVTFMMWWSQPRLFVGRGMHEGAFSLFKYTMFWVLLLATKLIVSYYVEIKPLVRPTKDIMKEPIRTFQWHEFFPHGNNNIGIVIALWAPIILVYFMDTQIWYAIFSTLIGGIYGACRRLGEIRTLGMLRSRFESLPKAFNQRLIPSDSNKRRGIRAAFSSKPTKTPEDSKEEEKIAARFAQIWNLIITSFREEDLIDNREKDLLLVPYCKDRDMDIIQWPPFLLASKIPIALDMAADSEGKDRDLKKRVKSDPYFTYAIKECYASFKNIIYTLVVGAKERDVIQKIFTVVDDHIAQDTLIKELNMSNLPTLSKKFIELLELLQKNNKEDQGQVIILFQDMLEVVTRDIMDEQLSGLLESVHGGNNRRYEGITPLDQQDQLFTKAIDFPVKESHAWTEKIKRLHLLLTVKESAMDVPTNLDARRRISFFANSLFMDMPSAPKVRHMLPFSVLTPYYKEDVLFSSQALEDQNEDGVSILFYLQKIYPDEWKHFLQRVDCNTEEELRETEQLEDELRLWASYRGQTLTRTVRGMMYYRQALVLQAFLDMARDEDLREGFRAADLLNDESPLLTQCKAIADMKFTYVVSCQQYGIQKRSGDHRAQDILRLMTTYPSLRVAYIDEVEEPSKDRNKKIEKVYYSALVKAAVTKPDDPGQKLDQDIYRIKLPGNAMLGEGKPENQNHAIIFTRGEGLQTIDMNQEHYMEETLKMRNLLQEFLKKHDGVRYPSILGVREHIFTGSVSSLAWFMSNQETSFVTIGQRVLANPLRVRFHYGHPDIFDRLFHLTRGGVSKASKIINLSEDIFAGFNSTLREGNVTHHEYMQVGKGRDVGLNQISLFEAKIANGNGEQTLSRDVYRLGHRFDFFRMLSCYYTTIGFYFSTMMTVWTVYVFLYGRLYLVLSGLDEALATGKRFIHNEPLQVALASQSFVQLGFLMALPMMMEIGLERGFRTALSDFVLMQLQLASVFFTFSLGTKTHYYGTTLLHGGAEYRATGRGFVVFHAKFAENYRLYSRSHFVKGIELLILLIVYEIFGQSYRGAIAYIFITFSMWFMVVTWLFAPFLFNPSGFEWQKIVDDWTDWNKWISNRGGIGVPPEKSWESWWEKEQEPIKYSGKRGIVLEIVLALRFFIYQYGLVYHLNITKHTKSVLVYCLSWVVIFVILLVMKTVSVGRRKFSADFQLVFRLIKGLIFITFISIIIILIAIPHMTVQDIFVCILAFMPTGWGLLLVAQAIKPVIVRIGLWGSIKALARGYEIIMGLLLFTPIAFLAWFPFVSEFQTRMLFNQAFSRGLQISRILGGHKKDRATRNKE

SEQ ID NO: 20 - protein, 1955 aa, Arabidopsis lyrata subsp. lyrata
MTWQFLLTVGSLGEAMLDSEVVPSSLVEIAPILRVANEVEASNPRVAYLCRFYAFEKAHRLDPTSSGRGVRQFKTALLQRLERENETTLAGRQKSDAREMQSFYQHYYKKYIQALLNAADKADRAQLTKAYQTAAVLFEVLKAVNQTEDVEVADEILETHNKVEEKTQIYVPYNILPLDPDSQNQAIMRLPEIQAAVAALRNTRGLPWTAGHKKKLDEDILDWLQSMFGFQKDNVSNQREHLILLLANVHIRQFPKPDQQPKLDDRALTIVMKKLFRNYKKWCKYLGRKSSLWLPTIQQEVQQRKLLYMGLYLLIWGEAANLRFMPECLCYIYHHMAFELYGMLAGSVSPMTGEHVKPAYGGDDEAFLQKVVTPIYQTIAKEAKRSRGGKSKHSVWRNYDDLNEYFWSIRCFRLGWPMRADADFFCHTAEELRIERSEIKSNSGDRWMGKVNFVEIRSFWHIFRSFDRMWSFYILCLQAMIVIAWNGSGELSAIFQGDVFLKVLSVFITAAVLKLAQAVLDIALSWKARHSMSLYVKLRYVMKVGAAAVWVVVMPVTYAYSWKNASGFALTIKNWFGGHSHNSPSLFIVAILIYLSPNMLSALLFLFPFIRRYLERSDFKIMMLMMWWSQPRLYIGRGMHESALSLFKYTMFWIVLLISKLAFSYYAEIKPLVGPTKDIMRIHISVYSWHEFFPHAKNNIGVVIALWSPVILVYFMDTQIWYAIVSTLVGGLNGAFRRLGEIRTLGMLRSRFQSIPGAFNDCLVPHDKSEDTKKKGFRATFSRKFDQLPSSKDKEAARFAQMWNKIISSFREEDLISDREMELLLVPYWSDPDLDLIRWPPFLLASKIPIALDMAKDSNGKDRELKKRLAVDSYMTCAVRECYASFKNLINYLVVGEREGQVINDIFSKIDEHIEKETLITELNLSALPDLYGQFVRLIEYLLENREEDKDQIVIVLLNMLEVVTRDIMEEEVPSLLETAHNGSYVKYDVMTPLHQQRKYFSQLRFPVYSQTEAWKEKASLFHLSHSCFHHSGAFDLFGMRNIKRLHLLLTVKESAMDVPSNLEARRRLTFFSNSLFMDMPAAPKIRNMLSFSVLTPYFSEDVLFSISGLEQQNEDGVSILFYLQKIFPDEWTNFLERVKCGSEEELRAREDLEEELRLWASYRGQTLTKTVRGMMYYRKALELQAFLDMAKDEELLKGYKALELTSEEASKSGGSLWAQCQALADMKFTFVVSCQQYSIHKRSGDQRAKDILRLMTTYPSIRVAYIDEVEQTHKESYKGTEEKIYYSALVKAAPQTKPMDSSESVQTLDQLIYRIKLPGPAILGEGKPENQNHAIIFTRGEGLQTIDMNQDNYMEEAFKMRNLLQEFLEKHGGVRCPTILGLREHIFTGSVSSLAWFMSNQENSFVTIGQRVLASPLKVRFHYGHPDIFDRLFHLTRGGICKASKVINLSFNSTLREGNVTHHEYIQVGKGRDVGLNQISMFEAKIANGNGEQTLSRDLYRLGHRFDFFRMLSCYFTTIGFYFSTMLTVLTVYVFLYGRLYLVLSGLEEGLSNQRAFRNNKPLEAALASQSFVQIGFLMALPMMMEIGLERGFHNALIEFVLMQLQLASVFFTFQLGTKTHYYGRTLFHGGAEYRGTGRGFVVFHAKFAENYRFYSRSHFVKGLELMILLLVYQIFGQSYRGVVTYILITVSIWFMVVTWLFAPFLFNPSGFEWQKIVDDWTDWNKWIYNRGGIGVPPEKSWESWWEKELEHLRHSGVRGIILEIFLALRFFIFQYGLVYHLSTFKGKNQSFWVYGASWFVILFILLIVKGLGVGRRRFSTTFQLLFRIIKGLVFLTFVAILITFLALPLITIRDLFICMLAFMPTGWGMLLIAQACKPLILQLGIWSSVRTLARGYEIVMGLLLFTPVAFLAWFPFVSEFQTRMLFNQAFSRGLQISRILGGQRKDRSSKNKE

SEQ ID NO: 21 - protein, 1944 aa, Populus trichocarpa
MSNRRGSDQQPPQKRILRTQTAGNLGESMLDSEVVPSSLVEIAPILRVANQVEGSNPRVAYLCRFYAFEKAHRLDPTSSGRGVRQFKTALLQRLERENDTTMQGKTISDAREMQRFYLDYYQKYIQALRDAADKADRAQLTKAYQTAAVLFEVLRAVNTTEAVKVDDEVLEAQTEVEEKNRIYVPYNILPLDPESEHQVIMRYPEIKATVIALRNTRGLPWPKGHKKRVNEDILDWLQAMFGFQKDNVENQREHLILLLANVHIRQFPKPDQQPKLDDMAVTDIMKKLFKNYKKWCKYLGRKSSLWLPTIQQEVLQRKLLYMGLYLLIWGEAANLRFMPECLCYIYHHMAFELYGMLAGSVSPMTGEHIKPAYGGENEAFLRKVVKPIYDTIAREAKMSKDGSSKHSQWRNYDDLNEYFWSADCFRLGWPMRADADFFCPSALGLRAEKDEVKKPVTGDRWIGKVNFVEIRSFWHIFRSFDRMWSFFILCLQAMIIIAWNGSGKLSSIFEGDVFKKVLSIFITSTILNFGQAVIDIILMWKARKTMPFYVKIRYVLKVLSAAAWVIILPVTYAYSWKNPPGLGQTIKKWFGSSPSSPSLFIMAILIYLSPNILSVLLFVFPLIRRVLERSNNKIVLFLMWWSQPRLYVGRGMHESSVSLIKYTMFWVLLLVSKLAFSFFVEIKPLVGPTKAVMKARIHDYQWHEFFPQAKSNIGVVISLWAPVVLVRLFHWHLSAIVYFMDTQIWYAIYSTIFGGIYGAFRRLGEIRTLGMLRSRFESLPGAFNACLIPPEKVETIKKRGLNAIFSRRNTGITESNKEKEEARFAQMWNKIITSFWEEDLIDNREMNLMLVPYWADRDLDLIQWPPFLLASKIPIALDMAKDSNRNDRELKNRLASDNYMHCAVRECYASFKSIINFLVQGDGEKQVIEDIFARVDEYIEKDTLIQELNMSALPILNEQFVKLIDFLIINNKEDKNRVVILLLDMLEVVTRDILEDDIPSLMDSNHGGSYGNDEGMTPIDQQHTFLGKLGFPVPETEDWKERIRRLHLLLTVKESAMDVPSNLEARRRISFFSNSLFMEMPSAPKVRNMLSFTVLTPYYREEVNYSINLLEKQNDDGVSILFYLQKIFPDEWKNFLERVGCNSEEELRANDVLEEELRLWASYRSQTLTKTVRGMMYYRKALELQAFLDMANDEELMRGYKAAELNSEGPSKSDNSTWQQCQAIADLKFTYVVSCQEYGKHKRAGHPLAKDILRLMTTYPSLRVAYIDEVEETGKDKSKKMVEKVYYSTLVKVAPPTKPIDSSEPIQNLDQVIYRIKLPGPAMLGEGKPENQNHAIIFTRGEALQTIDMNQDNYMEEAFKVRNLLQEFLKKHDGVRYPTILGLREHIFTGSVSSLAWFMSNQETSFVTIGQRLLASPLKVRFHYGHPDVFDRLFHLTRGGVSKASKVINLSEDIFAGIVSILHYVKAMLLIMNISKLISMFEAKIANGNGEQTLSRDIYRLGHRFDFFRMLSCYFTTIGFYFSTMLTVLTVYVFLYGRLYLVLSGLEKGLSTQRAIRDNKALQVALASQSFVQIGFLMALPMMMEIGLEKGFRNALSDFILMQLQLAPVFFTFSLGTKTHYYGRTLLHGGSAYRATGRGFVVFHAKFADNYRLYSRSHFVKGIELMILLLVFHIFGRSYRGVVAYVLITISMWFMVGTWLFAPFLFNPSGFEWQKILDDYTDWNKWINNRGGIGVHPDKSWESWWEKEQEHLRFSGKRGIIVEILLSLRFFIFQYGLVYHLSIVYGVSWIVIILVLFLMKAVAVGRRQLSANFQLLFRLIKGLIFITFISVFITLIALPHMTIRDVIVCILAFLPSGWGLLLIAQACKPLIQHAGFWGSVRTLARGYEIVMGLLLFTPVAFLAWFPFVSEFQTRMLFNQAFSRGLQISRILGGPRKDRTSRNKE

SEQ ID NO: 22 - protein, 1965 aa, Sorghum bicolor
MAAPGRRTADVSSSSPAPSPSPAAPSSTGRRLLRTQTVGNLGESIFDSEVVPSSLVEIAPILRVANEVEATNPRVAYLCRFYAFEKAHRLDPTSSGRGVRQFKTALLQRLERENDPTLKGRVHQSDAREMQRFYREYYKKYIQALQNAADKADRALLTKAYQTAAVLFEVLRAVNVSQSVEVDQAILDTHNKVEEKKKLFLPCNILPLDPESTGQAIMLYPEIQAAVYALRNTRGLPWPKDQDKKPDEKNTGKDLLDWLQAMFGFQKDNVSNQREHLILLLANVHIRKIPKADLQPKLDDKALDDVMKKLFKNYKKWCKYLGRKSSLWLPTIQQEVQQRKLLYMGLYLLIWGEAANLRFMPECICYIYHHMAFELYGMLAGNVSPMTGENVKPAYGGDEEAFLMKVVTPIYKVIEKEAERSKTMKSKHSHWRNYDDLNEYFWSVDCFRLGWPMRADADFFKTPKDAYPNLLNGENRSAGNVHWMGKVNFVEIRSFWHIFRSFDRMWIFLILSLQAMIIIAWNGGTPSDIFDAGVFKKVLSIFITAAILKLGQAILDLVFGWKARRSMSFAVKLRYVLKLISAAAWVVILPVTYAYTWENPTGLARTIKSWLGDGQNQPSLYILAIVIYMAPNILASMLFLFPFMRRFLESSNVKVITIMMWWSQPRLFVGRGMHEGAFSLFKYTMFWIILLAMKLIVSFYIEIKPLVQPTKDIMREPIRTFQWHEFFPHGTNNIGVVISLWAPIILVYFMDTQIWYALFSTLIGGIYGAYRRLGEIRTLGMLRSRFESLPEAFNERLIPSDANKSKGLRAAFLSRPKVPGDEREREKRAARFAQMWNVIITSFREEDLIDNREMDLLLVPYCKDRELDIFQWPPFLLASKIPIALDMAADSGGKDRDLTKRIKSDPYFSFAIRECYASFKNIINTLVFGQREKDVLAKIFTVVDEHIEDGTLIKDLNMRNLPALSKKFVELLELLQKNKEEDLGQVVILFQDMLEVVTRDIMEEQDQLSTLLDSIHGAHSRKHEGITPLDQQDQLFAKAIKFPVEESNAWTEKIKRLHLLLTVKESAMDVPTNLDARRRISFFANSLFMDMPNAPKVRNMLPFSILTPYYKEDVLFSLQNLEEPNEDGVSILFYLQKIYPDEWKNFLERVGCKNEEELREDEELEEKLRLWASYRGQTLTRTVRGMMYYRKALELQAFLDMAKDDDLMEGYRATEVMPEDSQLMTQCKAIADMKFTYVVSCQQYGIQKRSNEPCAHDILRLMTEYPSLRVAYIDEVEAPSQDRNKKIEKVYYSVLVKASVTKPNEPGQSLDQVIYKIKLPGNAILGEGKPENQNHAIIFTRGECLQTIDMNQEHYMEEALKMRNLLQEFQKKHDGVRYPSILGVREHIFTGSVSSLAWFMSNQETSFVTIGQRVLANPLRVRFHYGHPDVFDRLFHVTRGGVSKASKIINLSEDIFAGFNSTLREGNVTHHEYMQVGKGRDVGLNQISLFEAKIANGNGEQTLSRDIYRLGHRFDFFRMLSCYYTTIGFYFSTMITVWTVYVFLYGRLYLVLSGLDEALATGRRFVRNAPLQVALASESFVQLGFLMALPMMMEIGLERGFRTALSDFILMQLQLASVFFTFSLGTKTHYYGRTLLHGGAEYRATGRGFVVFHAKFADNYRLYSRSHFVKGIELMILLVVYEIFGQSYRGAITYIFITVSMWFMVGTWLFAPFLFNPSGFEWQKIVDDWTDWHKWISNRGGIGVAPEKSWESWWEKEQEPLRYSGKRGTIVEILLALRFFIYQYGLVYHLNITKKITKDNQSVLVYCFSWVVIFVILLVMKTVSVGRRRFSAEFQLVFRLIKGLIFITFTAIVVILIAIPGMTVLDIFVCILAFMPTGWGLLLIAQAIRPVIQKIGLWGSIKALARGYEILMGLLLFTPIAFLAWFPFVSEFQTRMLFNQAFSRGLQISRILGGHKKDRGTRNKE

SEQ ID NO: 23 - protein, 1959 aa, Oryza sativa Japonica Group
MAAPGGARRPDFSSAASPSPSPAGAAGRRLLRTQTVGNLGESIFDSEVVPSSLVEIAPILRVANEVEATNPRVAYLCRFYAFEKAHRLDPTSNGRGVRQFKTALLQRLERENDPTLKGRVHQSDAREMQRFYREYYKKYIQALQNAADKADRALLTKAYQTAAVLFEVLKAVNVSQSVEVDQAILDTHNKVEEKKKLYVPYNILPLDPESTYQPIMQYPEIQAAVNALRNIRGLPWPKEHEKKPDEKKTGKDLLDWLQAMFGFQKDNVSNQREHLILLLANVHIRQSPKTEQQAKLDDRALDAVMKKLFKNYKKWCKYLGRKSSLWLPTIQQEVQQRKLLYMGLYLLIWGEAANLRFMPECLCYIYHHMAFELYGMLAGNVSPMTGENVKPAYGGDEEAFLMKVVTPIYKVIEKEAERSKTIKSKHSHWRNYDDLNEYFWSVDCFRLGWPMRADADFFKTPEDAYPSRLNGENRSAGNVHWMGKINFVEIRSFWHIFRSFDRMWIFLILSLQAMIIIAWNGGTPSDIFDVGVFKQVLSIFITAAVLKLGQAILDIVFGWKARRSMSFAVKLRYVLKLISSSAWVVILPVTYAYTWDSPTGLARIIKSWLGNGQNQPSLYILAVVIYLAPNMLAAMLFLFPFLRRFLESSNVKVITFIMWWSQPRLFVGRGMHEGAFSLFKYTMFWVLLLAMKLTVSFYIEIKPLVQPTKDIMKEPIRDFQWHEFFPRANNNIGVVIALWAPIILVYFMDTQIWYALFSTLIGGIYGAYRRLGEIRTLGMLRSRFESLPEAFNEHLIPSDSHKSKGLRAAFTGKPSKTSGDEQEKEKIAARFAQMWNLIITSFREEDLIDNREMDLLLVPYCKDRELNIFQWPPFLLASKIPIALDMAADSGGKDRDLKKRMGSDPYFSYAIRECYGSFKNIINTLVFGQREKIVIQQIFTIVDEHIEGGSLIKDLNMRSLPALSKKFIELLELLQKNKEEDLGQVVILFQDMLEVVTRDIMDEQDQLGGLLDSVHGGNRKHEGMTSLDQQDQLFTKAIRFPVEESNAWTEKIKRLHLLLTVKESAMDVPTNLDARRRISFFANSLFMEMPNAPKVRHMLPFSVLTPYYKEDVLFSSHNLEEPNEDGVSILFYLQKIYPDEWKNFLDRVDRKSEEELREDETLEEELRLWASYRGQTLTRTVRGMMYYRKALELQAFLDMAKDDDLMEGYRATELMSEDSQLMTQCKAIADMKFTYVVSCQQYGIQKRSGEACAHDILRLMTVYPSLRVAYIDEVEAPSQDRNKKTDKVYYSALVKASVTKPNEPGQSLDQVIYKIKLPGNAILGEGKPENQNHAIIFTRGECLQTIDMNQEHYMEEALKMRNLLDEFLKKHDGVRYPSILGVREHIFTGSVSSLAWFMSNQETSFVTIGQRVLANPLRVRFHYGHPDIFDRLFHLTRGGVSKASKIINLSEDIFAGFNSTLREGNVTHHEYMQVGKGRDVGLNQIALFEAKIANGNGEQTLSRDIYRLGHRFDFFRMLSCYYTTIGFYFSTMITVWTVYVFLYGRLYLVLSGLDQALATGKKFVHNAPLQVALASESFVQLGFLMALPMMMEIGLERGFRTALSDFVLMQLQLASVFFTFSLGTKTHYYGRTLLHGGAEYRATGRGFVVFHAKFADNYRLYSRSHFVKGIELMILLVVYEIFGQSYRGAITYIFITVSMWFMVGTWLFAPFLFNPSGFEWQKIVDDWTDWNKWISNRGGIGVAPTKSWESWWEKEQEPLRYSGKRGTILEILLALRFFVYQYGLVYHLNITKHTRSVLVYCFSWVVIFVILLVMKTVSVGRRRFSAEFQLVFRLIKGLIFITFVAIVVILIAIPHMTVLDIFVCILAFMPTGWGLLLIAQAIKPAVQAIGLWGSIKALARGYEILMGLLLFTPIAFLAWFPFVSEFQTRMLFNQAFSRGLQISRILGGHKKDRSTRNKE

SEQ ID NO: 24 - protein, 1942 aa, Sorghum bicolor
MASSSGGGGGRRLAPGGDASPASAGARRIYRTQTAGNLGDSIFDSEVVPSSLVEIAPILRVANEVEASNPRVAYLCRFYAFEKAHRLDPTSSGRGVRQFKTALLQRLERENDPTLKGRVKQSDAREMQSFYQHYYKKYIQALQNAADKADRAQLTKAYQTAAVLFEVLKAVNVSQKIEVDQSILETHNQVEEKKKLYLPYNILPLDPDSANQAIMRYPEIQAAFHALRNTRGLPWPKEHDKKPDADLLAWLQAMFGFQKDNVSNQREHLILLLANVHIRQIPKPEQQPKLDDRALDTVMKKLFKNYKRWCKYLGRKSSLWLPTIQQEVQQRKLLYMGLYLLIWGEAANLRFMPECLCYIYHHMAFELYGMLAGNVSPTTGENVKPAYGGEEEAFLKRVVTPIYKVIEKEVERSKTMKSKHSHWRNYDDLNEYFWSRDCFRLGWPMRSDADFFKTPNVSLHHLDGEDRPVGNGNWMGKVNFVEIRSFWHIFRSFDRMWSFLILSLQAMIIIAWNGGTPSDIFDRGVFKQVLSIFITAAILKLGQAILDIILSWKARRNMSLVVKLRYILKLLSAAAWVVILPVTYAYTWENPTGLARTIKSWLGDGQNQPSLYILAVVIYLAPNLLSATLFLFPVIRRALERSNLRVVTFIMWWSQPRLFVGRGMHEGAFSLFKYTMFWVLLLATKLVVSFYVEIKPLVQPTKDIMKEPIRTFKWHEFFPHANNNIGVVIALWAPIILVYFMDTQIWYAIFSTLIGGVYGACRRLGEIRTLGMLRSRFESLPKAFNQCLIPSDTSKRRGFRAAFSKPSKTPEDTKEEEKIAARFAQIWNLIITSFREEDLIDDREKDLLLVPYCKDRDMDIIQWPPFLLASKIPIALDMAADSGGKDRDLKKRMKSDPYFTYAIKECYASFKNIIYALVISSRERGFIQKIFDMVDEHITEETLIKELNMSNLPTLSKKFIELLDLLESNNKEEQGQVIILFQDMLEVVTRDIMVDQLSDLLESIHGPNNKRSEGMMPLDQQVQLFTKAIDFPIKRLRLLLTVKESAMDVPTNLDARRRISFFANSLFMSMPDAPKVRQMLPFSVLTPYYKEDVLFSSQALGEQNEDGVSILFYLQKIYPDEWKNFLERVHCESEDQLHETEQSEEQLRLWASYRGQTLTRTVRGMMYYRQALVLQAFLDMARDDDLMEGFRAADLLSESDESQLLTQCKAIADMKFTYVVSCQQYGIQKRSGDPHAQDILRLMTTYPSLRVAYIDEVEEPSKDRNKKIEKVYYSALVKAAVTKPDDPGQKLDQDIYRIKLPGNAMLGEGKPENQNHAIIFTRGEGLQTIDMNQEHYMEETLKMRNLLQEFLKKHDGVRYPSILGVREHIFTGSVSSLAWFMSNQETSFVTIGQRVLANPLRVRFHYGHPDIFDRLFHLTRGGVSKASKIINLSEDIFAGFNSTLREGNVTHHEYMQVGKGRDVGLNQISLFEAKIANGNGEQTLSRDVYRLGHRFDFFRMLSCYYTTIGFYFSTMITVWTVYVFLYGRLYLVLSGLDEALATGKRFIHNEPLQVALASQSFVQLGFLMALPMMMEIGLERGFRTALSDFVLMQLQLASVFFTFSLGTKTHYYGTTLLHGGAEYRATGRGFVVFHAKFAENYRLYSRSHFVKGIELMILLIVYEIFGQSYRGAIAYIFITISMWFMVVTWLFAPFLFNPSGFEWQKIVDDWTDWNKWISNRGGIGVPPEKSWESWWEKEQEPLRHSGKRGTVLEIVLALRFFIYQYGLVYHLNITTHTKSVLVYCISWVIIFVILLVMKTVSVGRRKFSAEFQLVFRLIKGLIFITFISIIIILIAIPHMTVQDIFVCILAFMPTGWGLLLIAQTMRSAISHMGLWGSVKALARGYEIIMGLLLFTPIAFLAWFPFVSEFQTRMLFNQAFSRGLQISRILGGHKKDRAARNKE

SEQ ID NO: 25 - protein, 1936 aa, Arabidopsis lyrata subsp. lyrata
MAQRRGPDPPPPQRRILRTQTAGNLGEAMLDSEVVPSSLVEIAPILRVANEVEASNPRVAYLCRFYAFEKAHRLDPTSSGRGVRQFKTALLQRLERENETTLAGRQKSDAREMQSFYQHYYKKYIQALLNAADKADRAQLTKAYQTAAVLFEVLKAVNQTEDVEVADEILEAHTKVEEKSQIYVPYNILPLDPDSQNQAIMRFPEIQATVIALRNTRGLPWPAGHKKKLDEDMLDWLQTMFGFQKDNVSNQREHLILLLANVHIRQFPRPEQQPRLDDRALTIVMKKLFKNYKKWCMYLGRKSSLWLPTIQQEVQQRKLLYMGLYLLIWGEAANLRFLPECLCYIYHHMAFELYGMLAGSVSPMTGEHIKPAYGGEEEAFLQKVVTPIYKTIAKEAKRSRGGKSKHSEWRNYDDLNEYFWSVRCFRLGWPMRADADFFCQTAEELRLDRSENKPKTGDRWMGKVNFVEIRSFWHIFRSFDRMWSFYILCLQAMIIIAWNGSGDLSGIFQGDVFLKVLSIFITAAILKLAQAVLDIALSWKSRHSMSFHVKLRFIFKAVAAAIWVILMPLTYAYSWRTPSGFAQTIKNWFGGHQNSSPSFFIMVILIYLSPNMLSTLLFAFPFIRRYLERSDFKIVMLMMWWSQPRLYIGRGMHESALSLFKYTMFWVVLLISKLAFSFYAEQIKPLVKPTKDIMRVHISVYRWHEFFPHAKSNMGVVIALWSPVILVYFMDTQIWYAIVSTLVGGLNGAFRRLGEIRTLGMLRSRFQSLPEAFNACLIPSEKTEPPKKKGIMATFSRKFDQVPSSKDKEAARFAQMWNKIISSFREEDLISNREMELLLVPYWADRDLDIIRWPPFLLASKIPIALDMAKDSNGKDRELTKRLSVDSYMTCAVRECYASFKNLINFLVVGEREGQVINEIFSRIDEHIEKETLIKDLNLSALPDLYGQFVRLIEYLMQNREEDKDQIVIVLLNMLEVVTRDIMEEEVPSMLESTHNGTYVKYDVMTPLHQQRKYFSQLRFPIKRLHLLLTVKESAMDVPSNLEARRRLTFFSNSLFMEMPDAPKIRNMLSFSVLTPYYSEDVLFSIFGLEQQNEDGVSILFYLQKIFPDEWTNFLERVKCGSEEELRAREELEEELRLWASYRGQTLTKTVRGMMYYRKALELQAFLDMAKDEELMKGYKALELTSEDASKSGTSLWAQCQALADMKFTFVVSCQQYSIQKRSGDQRAKDILRLMTTYPSLRVAYIDEVEQTQKESYKGADEKIYYSALVKAAPQTKSMDSSESVQTLDQVIYRIKLPGPAILGEGKPENQNHSIIFTRGEGLQTIDMNQDNYMEEAFKMRNLLQEFLVKHGGVRTPTILGLREHIFTGSVSSLAWFMSNQENSFVTIGQRVLASPLKVRFHYGHPDVFDRLFHLTRGGVCKASKVINLSEDIFAGFNSTLREGNVTHHEYIQVGKGRDVGLNQISMFEAKIANGNGEQTLSRDLYRLGHRFDFFRMLSCYFTTIGFYFSTMLTVLTVYVFLYGRLYLVLSGLEEGLSNQKAFRSNMPLQAALASQSFVQIGFLMALPMMMEIGLERGFHNALIDFVLMQLQLASVFFTFQLGTKTHYYGRTLFHGGAEYRGTGRGFVVFHAKFAENYRFYSRSHFVKGIELMILLLVYQIFGHAYRGVVTYILITVSIWFMVVTWLFAPFLFNPSGFEWQKIVDDWTDWNKWIYNRGGIGVPPEKSWESWWEKEIGHLRHSGKRGIILEIVLALRFFIFQYGLVYQLSTFKQENQSLWIYGASWFVILFILLIVKGLGMGRQRFSTNFQLLFRIIKGFVFLTFLGILITFIALRLLTPKDIFLCMLAFMPTGWGMLLDSGHRLGRWLEAMRFSWVCFCEILMGLLLFTPVAFLAWFPFVSEFQTRMLFNQAFSRGLQISRILGGQRKDRSSKNKE

SEQ ID NO: 26 - protein, 1884 aa, Ricinus communis
MSSRRGSDHQPPQRRIMRTQTAGNLGESMLDSEVVPSSLVEIAPILRVANQVETSNPRVAYLCRFYAFEKAHRLDPTSSGRGVRQFKTALLQRLERENELTMQGRSMSDAREMQKFYRDYYQKYIQALQSAADKADRAQLTKAYQTAAVLFEVLKAVNQTEAVPEEILEAHTKVEEKTKIYVPYNILPLDPDSQNQAIMRYPEIQAAVSALRNIRGLPWPKDYKKRINEDILDWLQSMFGFQKDNVANQREHLILLLANVHIRQFPKTDQQPKLDDRALTDVMKKLFKNYKKWCKYLGRKSSLWLPTIQQEVQQRKLLYMGLYLLIWGEAANLRFMPECLCYIYHHMAFELYGMLAGSVSPVTGEHIKPAYGGEDEAFLGKVVKPIYDTIAEEAKRGKGGTSKHSQWRNYDDLNEYFWSVDCFRLGWPMRADADFFCPPIDGLQLEKDEVGLLTSNRWIGKVNFVEIRSFWHLFRSFDRMWSFLILCLQAMIIIAWQGSGKLSSIFEGDVFKKVLSIFITSAILNFAQAVIDIILSWKARKTMPFYVKLRYILKVLSAAAWVIILPVTYAYSWKNPPGFGQTIKKWFGNSASSPSLFILAILIYLSPNILSALLFLFPMVRRLLERSNYKIVMLVMWWSQPRLYVGRGMHESSIALFKYTIFWILLILSKLAFSYYAEIKPLVGPTKAIMKVRINRYQWHEFFPRAKSNIGVVIALWAPIVLVYFMDTQIWYAIYSTLFGGIYGAFRRLGEIRTLGMLRSRFQSLPGAFNACLIPVENSEKTKKKGLKATFSRKFNEVPSDKEKEEARFAQMWNKIITSFRDEDLINNREMDLMLVPYWADDDLDLIQWPPFLLASKIPIALDMAKDSNGKDRELKKRLTLDNYMHCAVRECYASFKSIIKFLVLGEKEKLVIDDIFFRVDEYIQNDTLIEELNMSALPTLYDQFVNLIEYLLINKKEDKDKVVILLLDMLEVVTRDIMDDEFPSLLESSHGGSYGKQEEMTLDRQYQFFGMLKFPVTETEAWKEKEVLYSINLLERPNEDGVSILFYLQKIFPDEWTNFLQRVGCNEEDLRASEELEEELRLWASYRGQTLTKTVRGMMYYRKALELQAFLDMATKKELMKGYKAAESSSEEQSKSERSLWAQCQAVADMKFTYVVSCQQYGIHKRSADPRARDILRLMTIYPSLRVAYIDEVEETSKDKSNKMVEKVYYSALVKAGPPTKPIDSSEPVQNLDQVIYRIKLPGPAMLGEGKPENQNHAIIFTRGEGLQTIDMNQDNYMEEAFKMRNLLEEFLQKHDGVRYPTILGLREHIFTGSVSSLAWFMSNQETSFVTIGQRLLASPLKVRFHYGHPDVFDRLFHLTRGGVSKASKVINLSEDIFAGFNSTLREGNVTHHEYIQVGKGRDVGLNQISMFEAKIANGNGEQTLSRDVYRLGHRFDFFRMLSCYFTTVGFYFSTFLTVLIVYVFLYGRLYLVLSGLEEALSTERAIRDNKPLQVALASQSFVQIGFLMALPMMMEIGLESGFRKALSDFILMQLQLAPVFFTFSLGTRTHYYGRTLLHGGAQYRGTGRGFVVFHAKFADNYRMYSRSHFVKGIELMILLLVYHIFGSSYRGVVPYILITVSIWFMVGTWLFAPFLFNPSGFEWQKIVDDWTDWNKWINNRGGIGVPPEKSWESWWEKEQEHLRYSGKRGIIVEILLALRFFIFQYGLVYRLSIIDDTKNFLVYGVSWVVIIVILLLMKAMSVGRRKFSADFQLLFRLIKGLIFVTFVAIFITLIALPHMTFKDILVCTLAFMPTGWGLLLIAQACKPLIQHVGFWGSVRTLARGYEIIMGLLLFTPVAFLAWFPFVSEFQTRMLFNQAFSRGLQISRILGGPRKDRSSKNKE

SEQ ID NO: 27 - protein, 1973 aa, Oryza sativa Japonica Group
MTSLSRTLSRGGPMQPPGQRRILRTQTAVNLGEQIFDSEVVPSSLVEIAPILRVANEVEASNPRVAYLCRFYAFEKAHRLDPTSSGRGVRQFKTALLQRLERENEPTLRGRARKSDAREIQAFYQHYYKKYIQALQNVSDQVDRAQLTKAYQTANVLFEVLKAVTQQHSVEVDHEILEAADKVKEKTKIYLPFNILPLDPDSGNQAVMKFPEIQAAAVALRNTRGLPWPKTYEHKVNEDLLDWLQSMFGFQTDNVSNQREHLILLLANVHIRRNPKTDPQSKLDDNALNEVMKKLFKNYKKWCKYLDRKSSLWLPTIQQEVQQRKLLYMGLYLLIWGEAANLRFMPECICYIYHHMAFEMYGMLVGNVSALTGEYVKPAYGGEKEAFLKKVVTPIYLTIAKEAERSKREKGNHSEWRNYDDLNEYFWSAECFRLGWPMRADADFFCQHLNSPDQRNETTRTEKQKGKVNFVELRSFWHIFRSFDRMWSFFILALQVMVILAWNGGSLGNIFDPVVFKKILSIFITSAILNLGQATLDIIFNWKARRTMEFAVKLRYVLKFTLAALWVVLLPVTYAYTWENPTGIIRAIKGWFGNGQNHPSLFVLAVVIYLSPSLLAAILFLLPFLRRILESSDYKFVRFVMWWSQLTTDQDNVENIVVSYYLRRRPDMTKQNPRLFVGRGMHESAFSLFMYTMFWIALLLIKFAFSYYVEIKPLVEPTKDIMKLPIHTFQWHEFFPKANGNIGVVIALWAPIILVYFMDTQIWYTIFSTLLGGIYGAFQRLGEIRTLGMLRSRFGSIPLAFNACLIPAEESDAKRKKGLKSYLHSRFERKHTDKEKIAARFAQMWNEIITSFREEDLINNKEKELLLVPYVADQALEIMQWPPFLLASKIPIAVDMAKDSNGKDRDLKKRLENDYYFKCAIEECYASFKNIIKDLVQGEPEKRVINTIFAEVEKYIADDKVITDLNMHALPDLYNKFVELVKYLEKNDKNDRDAVIKIFQDMLEVVTRDIMEDQLSSILESSHGGSYQRPEGTTTWDQEYQLFQPAGAIKFPVQFTDAWIEKIKRLELLLTVKESAMDVPSNLEARRRLTFFTNSLFMDMPDAPKVRNMLSFSALTPYYNEPVLFSIKELQEENEDGVSTLFYLQKIYPDEWKNFQQRVEWDEELKENEDKNEELRLWASYRGQTLARTVRGMMYYRKALVLEAFLDMAKHEDLMEGYKAVESTDEQWKLQRSLFAQCEAVADMKFTYVVSCQQYGNDKRAALPNAQDILQLMRTYPSLRVAYIDQVEDRVEEKKMEPAYYSTLVKVALTKDSESTDPVQNLDQVIYRIKLPGPAMLGEGKPENQNHAIIFTRGEGLQTIDMNQDNYMEEALKMRNLLQEFLTEHGVRRPSILGVREHIFTGSVSSLAWFMSNQEHSFVTIGQRLLANPLKVRFHYGHPDVFDRIFHLTRGGVSKASRSINLSEDIFAGYNSTLRGGNITHHEYVQVGKGRDVGLNQISKFEAKVANGNGEQTLSRDIYRLGHRFDFFRMLSCYFTTVGFYFSTLLTVVTVYVFLYGRLYLALSGLEEGLLTQRRYIHNHPLQVALASQSLVQLGFLMALPMMMEIGLEKGFGQALSEFIMMNLQLAAVFFTFSLGTKTHYYGRMLLHGGAQYRATGRGFVVFHAKFAENYRLYSRSHFVKGIELLILLIIYQLFGQSYRSTIAYIFVTFSMWFLVLTWLFAPFLFNPSGFEWTKIVDDWSDWNKWISNRGGIGVSPDKSWESWWEIELEHLKYSGTIGLFVEIILSLRFFIYQYGLVYHLNITGDKSILVYLISWLVILVVLLVMKTVSVGRRRFSADFQLFFRLIKFMIFVSFIAILIVLIAILHMTLRDIFVCFLAFLPSGWGILLIAQACKPLARRAGLWGSVRALARAYEIIMGVLLFTPITILAWFPFVSEFQTRMLFNQAFSRGLQISRILGGQKKERERSSRNKD

SEQ ID NO: 28 - protein, 1918 aa, Oryza sativa Japonica Group
MASSSSGRRVGGPRGGGESSPSPAAGAGAAASGGRRILRTQTAGNLGESIFDSEVVPSSLVEIAPILRVANEVEGSNPRVAYLCRFYAFEKAHRLDPTSSGRGVRQFKTALLQRLERENDPTLKGRVKQSDAREMQSFYQHYYKKYIQALQNAADKADRAQLTKAYQTAAVLFEVLKAVNVSQKIEVDQAILETHNQVEEKKKLYLPYNILPLDPDSANQAIMRYPEIQAAFHALRNTRGLPWPKDHEKKPDADLLGWLQAMFGFQKDNVSNQREHLILLLANVHIRQIPKPDQQPKVSLLLNVHIGACVILVLDDRALDTVMKKLFKNYKRWCKYLGRKSSLWLPTIQQEVQQRKLLYMGLYLLIWGEAANLRFMPECLCYIYHHMAFELYGMLAGNVSPTTGENVKPAYGGDEEAFLKKVVTPIYKVIEKEAERSESSERSERSKTTKSKHSHWRNYDDLNEYFWSRDCFRLGWPMRADADFFKTPDYAYHDEVSGENRRVGSGQWMGKVNFVEIRSFWHIFRSFDRMWSFLILSLQAMIIIAWNGGTPSDIFDAGVFKQVLSIFITAAILKLGQAILDIILSWKARRSMSLAGKLRYILKLISAAAWVVILPVTYAYTWENPTGLARTIKSWLGDGQNQPSLYILAVVIYLAPNMLSAVLFLFPVLRRALERSNLKVVTFMMWWSQIKKLVRPTKDIMKEPIRTFQWHEFFPHGNNNIGIVIALWAPIILIRTLGMLRSRFESLPKAFNQRLIPSDSNKRRGIRAAFSSKPTKTPEDSKEEEKIAARFAQIWNLIITSFREEDLIDNREKDLLLVPYCKDRDMDIIQWPPFLLASKIPIALDMAADSEGKDRDLKKRVKSDPYFTYAIKECYASFKNIIYTLVVGAKERDVIQKIFTVVDDHIAQDTLIKELNMSNLPTLSKKFIELLELLQKNNKEDQGQVIILFQDMLEVVTRDIMDEQLSGLLESVHGGNNRRYEGITPLDQQDQLFTKAIDFPVKESHAWTEKIKRLHLLLTVKESAMDVPTNLDARRRISFFANSLFMDMPSAPKVRHMLPFSVLTPYYKEDVLFSSQALEDQNEDGVSILFYLQKIYPDEWKHFLQRVDCNTEEELRETEQLEDELRLWASYRGQTLTRTVRGMMYYRQALVLQAFLDMARDEDLREGFRAADLLNDESPLLTQCKAIADMKFTYVVSCQQYGIQKRSGDHRAQDILRLMTTYPSLRVAYIDEVEEPSKDRNKKIEKVYYSALVKAAVTKPDDPGQKLDQDIYRIKLPGNAMLGEGKPENQNHAIIFTRGEGLQTIDMNQEHYMEETLKMRNLLQEFLKKHDGVRYPSILGVREHIFTGSVSSLAWFMSNQETSFVTIGQRVLANPLRVRFHYGHPDIFDRLFHLTRGGVSKASKIINLSEDIFAGFNSTLREGNVTHHEYMQVGKGRDVGLNQISLFEAKIANGNGEQTLSRDVYRLGHRFDFFRMLSCYYTTIGFYFSTMMTVWTVYVFLYGRLYLVLSGLDEALATGKRFIHNEPLQVALASQSFVQLGFLMALPMMMEIGLERGFRTALSDFVLMQLQLASVFFTFSLGTKTHYYGTTLLHGGAEYRATGRGFVVFHAKFAENYRLYSRSHFVKGIELLILLIVYEIFGQSYRGAIAYIFITFSMWFMVVTWLFAPFLFNPSGFEWQKIVDDWTDWNKWISNRGGIGVPPEKSWESWWEKEQEPIKYSGKRGIVLEIVLALRFFIYQYGLVYHLNITKHTKSVLVYCLSWVVIFVILLVMKTVSVGRRKFSADFQLVFRLIKGLIFITFISIIIILIAIPHMTVQDIFVCILAFMPTGWGLLLVAQAIKPVIVRIGLWGSIKALARGYEIIMGLLLFTPIAFLAWFPFVSEFQTRMLFNQAFSRGLQISRILGGHKKDRATRNKE

SEQ ID NO: 29 - protein, 1957 aa, Oryza sativa Indica Group
MTSLSRTLSRGGPMQPPGQRRILRTQTAVNLGEQIFDSEVVPSSLVEIAPILRVANEVEASNPRVAYLCRFYAFEKAHRLDPTSSGRGVRQFKTALLQRLERENEPTLRGRARKSDAREIQAFYQHYYKKYIQALQNVSDQVDRAQLTKAYQTANVLFEVLKAVTQQHSVEVDHEILEAADKVKEKTKIYLPFNILPLDPDSGNQAVMKFPEIQAAAVALRNTRGLPWPKTYEHKTDNVSNQREHLILLLANVHIRRNPKTDPQSKLDDNALNEVMKKLFKNYKKWCKYLDRKSSLWLPTIQQEVQQRKLLYMGLYLLIWGEAANLRFMPECICYIYHHMAFEMYGMLVGNVSALTGEYVKPAYGGEKEAFLKKVVTPIYLTIAKEAERSKREKGNHSEWRNYDDLNEYFWSAECFRLGWPMRADADFFCQHLNSPDQRNETTRTEKQKGKVNFVELRSFWHIFRSFDRMWSFFILALQVMVILAWNGGSLGNIFDPVVFKKILSIFITSAILNLGQATLDIIFNWKARRTMEFAVKLRYVLKFTLAALWVVLLPVTYAYTWENPTGIIRAIKGWFGNGQNHPSLFVLAVVIYLSPSLLAAILFLLPFLRRILESSDYKFVRFVMWWSQLTTDQDNVENIVVSYYLRRRPDMMKQNPRLFVGRGMHESAFSLFMYTMFWIALLLIKFAFSYYVEIKPLVEPTKDIMKLPIHTFQWHEFFPKANGNIGVVIALWAPIILVYFMDTQIWYTIFSTLLGGIYGAFQRLGEIRTLGMLRSRFGSIPLAFNACLIPAEESDAKRKKGLKSYLHSRFERKHTDKEKIAARFAQMWNEIITSFREEDLINNKEKELLLVPYVADQALEIMQWPPFLLASKIPIAVDMAKDSNGKDRDLKKRLENDYYFKCAIEECYASFKNIIKDLVQGEPEKRVINTIFAEVEKYIADDKVITDLNMHALPDLYNKFVELVKYLEKNDKNDRDAVIKIFQDMLEVVTRDIMEDQLSSILESSHGGSYQRPEGTTTWDQEYQLFQPAGAIKFPLQFTDAWIEKIKRLELLLTVKESAMDVPSNLEARRRLTFFTNSLFMDMPDAPKVRNMLSFSALTPYYNEPVLFSIKELQEENEDGVSTLFYLQKIYPDEWKNFQQRVEWDEELKENEDKNEELRLWASYRGQTLARTVRGMMYYRKALVLEAFLDMAKHEDLMEGYKAVESTDEQWKLQRSLFAQCEAVADMKFTYVVSCQQYGNDKRAALPNAQDILQLMRTYPSLRVAYIDQVEDRVEEKKMEPAYYSTLVKVALTKDSESTDPVQNLDQVIYRIKLPGPAMLGEGKPENQNHAIIFTRGEGLQTIDMNQDNYMEEALKMRNLLQEFLTEHGVRRPSILGVREHIFTGSVSSLAWFMSNQEHSFVTIGQRLLANPLKVRFHYGHPDVFDRIFHLTRGGVSKASRSINLSEDIFAGYNSTLRGGNITHHEYVQVGKGRDVGLNQISKFEAKVANGNGEQTLSRDIYRLGHRFDFFRMLSCYFTTVGFYFSTLLTVVTVYVFLYGRLYLALSGLEEGLLTQRRYIHNHPLQVALASQSLVQLGFLMALPMMMEIGLEKGFGQALSEFIMMNLQLAAVFFTFSLGTKTHYYGRMLLHGGAQYRATGRGFVVFHAKFAENYRLYSRSHFVKGIELLILLIIYQLFGQSYRSTIAYIFVTFSMWFLVLTWLFAPFLFNPSGFEWTKIVDDWSDWNKWISNRGGIGVSPDKSWESWWEIELEHLKYSGTIGLFVEIILSLRFFIYQYGLVYHLNITGDKSILVYLISWLVILVVLLVMKTVSVGRRRFSADFQLFFRLIKFMIFVSFIAILIVLIAILHMTLRDIFVCFLAFLPSGWGILLIAQACKPLARRAGLWGSVRALARAYEIIMGVLLFTPITILAWFPFVSEFQTRMLFNQAFSRGLQISRILGGQKKERERSSRNKD

SEQ ID NO: 30 - protein, 1909 aa, Selaginella moellendorffii
MATSRGDAGRRLSGTHTSGEVLDSEVVPSSLASIASILRVANDVEQERPRVAYLCRFYAFEKAHRLDPTSSGRGVRQFKTALLQRLEKDNASSLAQRVKRSDAKEIQYYYQQYYEKYVKALDKIDQSDRAKLAKAYQTAGVLFEVLCAVNKTEEVAPEIIALGEDVKEKKDIYAPYNILPLDAAGASQAIMQLPEIKAAVDALRNIRGLPFPAALEHQPNKSAEVDILDWLQQMFGFQKDSVANQREHLILVLGNSHVRNSQKSESTSSKLDDRALNEVFLKLFKNYKDWCKFLGRKSSLVLPEVPQEAQQRKLLYMGLFLLIWGEAANLRFMPECLCYIYHNMALELHGMLAGNVSFVTGEYIKPAYGGDEESFLRKVVTPIYDIIEKEARNNKNGTAPHSAWRNYDDLNEYFWYFGCFRLGWPMRADADFFLFIWQGTSGKRLSQRLNKTGFVEIRSFWHIFRSFDRMWTFFILALQVMIIISWSGTGSPSDIVRGDTLKQVSSIFITAAVLRFLQGVLDVIFSYKAYHSMRFTSTLRLFIKLVVSAAWVVVLSVLYVHTWESPRGLIGIIRRWLGHRWKNPSLYIAAVIVYVLPNVIGAFFFIFPAIRRWIENSNWRIIRFLLWWSQPRLYVGRGMHEGQFTLFKYTFFWVLLICSKLAFSYYVQINPLVKPTKNIMNTRNITYTWHEFFPNAKKNIGAVISVWVPVLLIYFMDTQLWYSVYSTLFGGISGAFRRLGEIRTLGMLRSRFQSLPETFNRNLVPKDRQSQLMLSLIQASGEQEAFAKFAQLWNEVITSFREEDLISNKDMDLMLVPYSASNMNVKQWPPFLLASKIPVAIQMAEHARKKDGLQLSDDYMRSAVTECYSAFKLVLNTLIAPNTREKTVIDEVFEEVDKSINGNTLRLYFKMSALRALNDKFVTLIEHLLNPSPDSRHSVSVLLQDMYEVVSKDMIVEDLWEEIEERIASKENKTAVPVDPANRQIDLFDIKTIRYPPPDTPAWVEQIKRLHLLLTVKETAMDVPTNLEARRRLTFFTNSLFMKMPEAPPVRNMLSFSVLTPYYAEEIVFTKEQLHEENEDGVSILFYLQKIFPDEWDNFLERIDCESESDIGHNEQHTLELRKWASFRGQTLSRTVRGMMYYRRALELQAFLDMASSQEILEGYKVVANSSEEAKRSQRSLWAQLQAIADMKFTYVATCQSYGIQKRSSDTRATDILNLMIKHPSLRVAYIDEVEQREKDKIKKVYYSVLVKAVNKLDQEIYRIKLPGPVKLGEGKPENQNHAIIFTRGEALQTIDMNQDNYLEEAFKMRNLLSEFRKNHGVRPPTILGVREHIFTGSVSSLAWFMSNQETSFVTIGQRVLANPLKVRFHYGHPDVFDRLFHITRGGISKASRVINLSEDIFAGFNSTLRQGNVTHHEYIQVGKGRDVGLNQISLFEAKVANGNGEQTLSRDVYRLGHRFDFFRMMSCYFTTVGFYYSTLLVVFTVYVFLYGRLYLAVSGMEKSLMQSADLNNDIPLQAALASQSLVQLGALMALPMVMELGLERGFRSAFSDFIVMQLQLAPVFFTFSLGTKTHYYGRTILHGGAKYRGTGRFFVVRHEKFAENYRLYSRSHFTKGLELLMLLIVYNVYGSSAKGTVAYLIVTFSMWFLVATWLFAPFLFNPSGFEWQKIVEDWEDWNKWINSKGGLGVSATKSWESWWEEEQEYLNHTGIEGRILEIILALRFFLYQYGLVYQLHVTGGSKSITIYGLSWLVIVAVLTVLKIVSMGRKRFSGDFQLMFRLLKALLFIGFLSIIVVLFVVVGLTVGDIFASILAFMPTGWALLLIFMASRPVIVKLGFWDSIRALARTYEFVMGLVLFAPVAVLAWFPFVSEFQTRLLFNQAFSRGLQISRILAGRKGKKSNQDKSTH

SEQ ID NO: 31 - protein, 1909 aa, Selaginella moellendorffii
MATSRGDAGRRLSGTHTSGEVLDSEVVPSSLASIASILRVANDVEQERPRVAYLCRFYAFEKAHRLDPTSSGRGVRQFKTALLQRLEKDNASSLAQRVKRSDAKEIQYYYQQYYEKYVKALDKIDQSDRAKLAKAYQTAGVLFEVLCAVNKTEEVAPEIIALGEDVKEKKDIYAPYNILPLDAAGASQAIMQLPEIKAAVDALRNIRGLPFPAALEHQPNKSAEVDILDWLQQMFGFQKDSVANQREHLILVLGNSHVRNSQKSESTSSKLDDRALNEVFLKLFKNYKDWCKFLGRKSSLVLPEVPQEAQQRKLLYMGLFLLIWGEAANLRFMPECLCYIYHNMALELHGMLAGNVSFVTGEYIKPAYGGDEESFLRKVVTPIYDIIEKEARNNKNGTAPHSAWRNYDDLNEYFWYFGCFRLGWPMRADADFFLFIWQGTSGKRLSRRLNKTGFVEIRSFWHIFRSFDRMWTFFILALQVMIIISWSGTGSPSDIVRGDTLKQVSSIFITAAVLRFLQGVLDVIFSYKAYHSMRFTSTLRLFIKLVVSAAWVVVLSVLYVHTWESPRGLIGIIRRWLGHRWKNPSLYIAAVIVYVLPNVIGAFFFIFPAIRRWIENSNWRIIRFLLWWSQPRLYVGRGMHEGQFTLFKYTFFWVLLICSKLAFSYYVQINPLVKPTKNIMNTRNITYTWHEFFPNAKKNIGAVISVWVPVLLIYFMDTQLWYSVYSTLFGGISGAFRRLGEIRTLGMLRSRFQSLPETFNRNLVPKDRQSQLMLSLIQASVEQEAFAKFAQLWNEVITSFREEDLISNKDMDLMLVPYSASNMNVKQWPPFLLASKIPVAIQMAEHAKKKDGLQLSDDYMRSAVTECYSAFKLVLNTLIAPHTREKTVIDEVFDEVDKSINENTLRLNFKMSALRALNDKFVTLIEHLLNPSPESRHSVSVLLQDMYEVVSKDMIVEDLWEEIEERIANKENKTAVPVDPANRQIDLFDIKTIRYPPPDTPAWVEQIKRLHLLLTVKETAMDVPTNLEARRRLTFFTNSLFMKMPEAPPVRNMLSFSVLTPYYAEEIVFTKEQLHEENEDGVSILFYLQKIFPDEWDNFLERIDCESESDIGHNEQHTLELRKWASFRGQTLSRTVRGMMYYRRALELQAFLDMASSQEILEGYKVVANSSEEAKRSQRSLWAQLQAIADMKFTYVATCQSYGVQKRSSDTRATDILNLMIKHPSLRVAYIDEVEQREKDKIKKVYYSVLVKAVNKLDQEIYRIKLPGPVKLGEGKPENQNHAIIFTRGEALQTIDMNQDNYLEEAFKMRNLLSEFRKNHGVRPPTILGVREHIFTGSVSSLAWFMSNQETSFVTIGQRVLANPLKVRFHYGHPDVFDRLFHITRGGISKASRVINLSEDIFAGFNSTLRQGNVTHHEYIQVGKGRDVGLNQISLFEAKVANGNGEQTLSRDVYRLGHRFDFFRMMSCYFTTVGFYYSTLLVVFTVYVFLYGRLYLAVSGMEKSLMQSADLNNDIPLQAALASQSLVQLGALMALPMVMELGLERGFRSAFSDFIVMQLQLAPVFFTFSLGTKTHYYGRTILHGGAKYRGTGRFFVVRHEKFAENYRLYSRSHFTKGLELLMLLIVYNVYGSSAKGTVAYLIVTFSMWFLVATWLFAPFLFNPSGFEWQKIVEDWEDWNKWINSKGGLGVSATKSWESWWEEEQEYLNHTGIEGRILEIILALRFFLYQYGLVYQLHVTGGSKSITIYGLSWLVIVAVLTVLKIVSMGRKRFSGDFQLMFRLLKALLFIGFLSIIVVLFVVVGLTVGDIFASILAFMPTGWALLLIFMASRPVIVKLGFWDSIRALARTYEFVMGLVLFAPVAVLAWFPFVSEFQTRLLFNQAFSRGLQISRILAGRKGKKSNQDKSTH

SEQ ID NO: 32 - protein, 1929 aa, Physcomitrella patens subsp. patens
MASGEGAETGSTHKPRRTSRASAVGGVTESFDSEVVPSSLAAIAPILRVANEIESSTPRVAYLCRYHAFEKAHRIDPKSSGRGVRQFKTALLQRLERDNEPTLALRHRRSDAREIQSYYQQYYNDYVKALDGAEHSDRAQLAKAYQTASVLFEVLKAVNRDKTEEPPPEIIAAAADVEQKKEIYVSYNVLPLDAAGASQAIMQLDEVRAAVESLRNVRGLPWQTEKESHPRAGDLDCLDWLQDMFGFQKDNVANQREHLILMLANVHNRLLPRPEPMHKLDDRALNAVMNKLFKNYKSWCKFLGRKHKLWLPRIHQEERQRKILYMGLYLLIWGEAANLRFMPECLCYIYHHMASELHGMLAGNVSMVTGDNMKPAYGGKAESFLTLVVTPIYDVISRETLKNKNGTAPHSAWRNYDDLNEYFWKVDCFCLGWPMRTDADFFVPTQRSSQRSEDSNGKFFQSTSKSFFVEIRTFWHLFRSFDRLWAFYILGLQAMIVLAWNVGPNLQYAFNGTVIKQVLSIFITASILRLIQGKVAFLDLFMGYHAFSSIKLLGVLRLILKLLVSAAWVIVLTVCYVRTWKNPQGLVGVIQKWFGSGWESSYLYIAAVVVYLVPNIIGACFFMFPMIRRWIESSNWPIVRVLLWWSQPRLYIGRGMHESQFALIGYTFFWVLLIASKFAFSYFIQIEPLVAPTKAIMQQTNVSYTWHEFFPKARNNPGALLSLWAPVILVYFMDSQIWYAVYSTIFGGISGSFRRLGEIRTLGMLRSRFSSLPGAFNESLVPDEDNRARKGFSFSRDFEKVAPPTNRSKAARFSQLWNEVITSFREEDLIILTGHRERDLMLVPYSSDPDLKLVQWPPFLLASKVPIALQMAKQAAETGRAADLLRKIKNDEYMKCAVVECYESFKRVLKRLIVGEVEIRVIEGLLAVVDENVEKETLLDNFNLGDLPLLSVKFIELLELLVEAIDNARDLVVLKLQDMYEVVTRDMMSETMSHGALAGGQGRKSELFSSKGDEPAKVLFPPPRKEAWIEQIKRLHLLLTERESAMDVPENLEARRRIAFFTNSLFMNMPRAPKVRNMLSFSVLTPYYKEDVVYSKENLMKENEDGISVLFYLQKIYPDEWNNFLQRLGLENSDDPEAQIFSSNDLEDKLREWASFRGQTLSRTVRGMMYYRRALELQAFLDMATDDELEDGYKILTDATPEQKKSQRSTWSQLQAIADMKFTYVAACQMYGDQKRQGHHSATEILKLMLNNPSLRVAYIDEVEERQNEKTSKVYYSVLVKAVNGLDQEIYRIKLPGTVRLGEGKPENQNHAVIFTRGEGLQTIDMNQDNYLEEAFKMRNLLQEFHEPHGVRPPTILGVREHIFTGSVSSLAWFMSNQETSFVTIGQRVLASPLKVRFHYGHPDVFDRLFHITRGGMSKASRVINLSEDIFAAGFNSILRRGNVTHHEYIQVGKGRDVGLNQISLFEAKIACGNGEQALSRDIYRLGHRFDFFRMLSCYFTTVGYYFSTMIVVLTVYIFLYGRIYLALSGVDDSLVHTANNKALTAALASQSLVQLGLLMALPMVMEIGLERGFRTALSDFLTMQLQLASVFFTFSLGTKTHYFGRTILHGGAKYRATGRGFVVRHERFADNYRLYSRSHFTKAIELFLLLIVYTLYVTKSAKGAVTYILITVSMWFLVASWLFAPFLFNPSGFEWQKIVEDWDDWNKWMSNRGGIGVEGSKSWESWWDEEQEHLNYTGFFGRLVESILSFRFFLYQYGIVYHLNIARSSNNLSISVYGLSWLVIVAVLAILKIVSMGRDKFSADFQLMFRLLKALVFIGSVSVIAILHVKNLTVGDLFASILAFIPTGWALIQIAVACKPVVINLGFWKSVKSLARGYEYMMGILLFTPIAVLSWFPFVSEFQTRLLFNQAFSRGLQISRILAGRKKL

SEQ ID NO: 33 - protein, 1619 aa, Hordeum vulgare
MGLYLLIWGEAANLRFMPECLCYLYHHMAFELYGVLSGNVSPSTGENVRPFYGGEEEAFLKKVVNPISKIIEMDEAERSGKIKSKHSHWRNYDDLNEYFWSRDCFRLGWPMRADADFFKTPNFVLNTRDQANGENRPTGNDHWMGKVNFVEIRSFWHIFRSFDRMWSFLILSLQAMVIVAWNGGTPGDIFDAGVFKQVLSIFITAAVMKMGQAILDIVLSWKARKSMSLAVKLRYILKLLSGAAWVVILPVTYAYTSDNPTGLNRTIKSWFGDGRNQPSLYILAVVVYLSPNMLAATLFIFPVLRRFLEKSNLKVVALIMWWSQPRLFVGRGMHEGAFSLFKYTMFWVVLLATKLVVSFYVEIRPLVQPTKDIMKVPITTFQWHEFFPHAKNNIGVVIALWAPIILVYFMDTQIWYAIFSTLVGGIYGACRRLGEIRTLGMLRSRFESLPKAFNDHLIPNDSKRRGFRSAFSSKPSKKPEDGKEEDKIAARFAQIWNLIITSFRQEDLIDNREKDLLLVPYCKDREMDMIQWPPFLLASKIPIALDMAADSGGKDRDLKKRMDSDPYFTYAIKECYASFKNIIYALVVGPRERDVIQKIFKVVDDLVAEDFLIKELHMSNLPTLSKKFIELLEILQKNNREDRGQVIILFQDMLEVVTRDIMEEQLQPIGLLETVHGGNNRKHEGITPLDQQEQEQLFTKAIEFPVKASDAWKEKIKRLHLLLTVKESAMDVPTNLDARRRISFFANSLFMDMPKAPKVRNMLPFSVLTPYYKEDVLFSSHALEEENEDGVSILFYLQKIYPDEWKNFLERVDCKNEEELRETEQTEDELRLWASYRGQTLTRTVRGMMYYRQALVLQSCLDMAREDDLMEGFRAADILSEESQLLTQCKAVADMKFTYVVSCQSYGIQKRSGDHHAQDILRLMTTYPSLRVAYIDEVEETSKEGEASKDRSKKIEKVYYSALVKAAVTKPHDPGRKLDQDIYRIKLPGNAMLGEGKPENQNHAIIFTRGEGLQTIDMNQEHYMEETLKMRNLLQEFTKKHDGVRYPTILGVREHIFTGSVSSLAWFMSNQETSFVTIGQRVLANPLRVRFHYGHPDIFDRLFHLTRGGVSKASKIINLSEDIFAGFNSTLREGNVTHHEYMQVGKGRDVGLNQISLFEAKIAYGNGEQTLSRDIYRLGHRFDFFRMLSCYYTTIGFYFSTMITVWTVYVSLYGRLYLVLSDLDEGLATGRRFIHNNPLQVALASQSFVQLGFLMALPMMMEIGLERGFRTALSDFVLMQLQLASVFFTFSLGTKTHYYGKTLLHGGAEYRATGRGFVVFHAKFAENYRLYSRSHFVKGIELMILLIVFEIFGQSYRGAIAYIFITFSMWFMVVTWLFAPFLFNPSGFEWQKIVDDWTDWNKWISNRGGIGVSPEKSWESWWEKEHEPLKYSGKRGTVLEIVLAVRFFIYQYGLVYHLNITKHTKSVLVYCLSWVVIFFILLVVKAMSVGRRKFSAEFQLVFRLLKGLISIVFISTIVILIVIPHMTIQDIFVCILAFMPTGWGLLLVAQALKPAIMRVGLWGSIRALARGYEIIMGLVLFTPYAFLAWFPFVFEFQTRMLFNQAFSRGLQISRILGGH

SEQ ID NO: 34 - protein, 1930 aa, Vitis vinifera
MSSIDSGPQGLTRRPSRSSATTTFSTEVFDHEVVPSSLGSIVPILRVATEIEPERPRVAYLCRFYAFEKADRLDPNSSGRGVRQFKTGLLQRLERENSSSLASRVKKSDAREIQSFYQQYYQNYVRALDKGEQADRAQLGKAYQTAGVLFEVLCAVNKTEKVEEVAPEIIAAATDVQEKKEIYAPYNILPLDSAGATQSIMQLEEVKAAVGALWNTRGLNWPTEFERHRQKAGDLDLLDWLRAMFGFQAYNVRNQREHLILLLANNHTALHPKPEPLNKACTDLSFELDERAIDAIMDKLFKNYKTWCKFLGRKHSLRLPQGQQEIQQRKMLYMGLYLLIWGEAANVRFMPECLCYIFHNMAYELHGLLAGNVSIVTGENIKPSYGGDDESFLRKVITPLYRVIEKEAKKSKHGKAPHSSWCNYDDLNEYFWSSDCFSLGWPMRDDGDFFKSTRDMVAQGRKGSNRKSGSTGKSYFVETRTFWHIFRSFDRLWTFYILALQAMIIIAWHDNLSLSDIFRTDMLHNLSSIFIPASFLRFLQSILDLILNFPGYHRWKFTDVLRNILKMVVSLAWAVILPLFYVHSFVAPNKIRDVLSRLHEIKGIPTLYVVAVFLYLLPNLLAAVLFIFPMLRRWIENSDWHIIRFLLWWSQPRIYVGRGMHESQFALLKYTIFWALLLCSKFAFSYFIQIKPLVKPTKSIMRINLVHYAWHEFFPQAKKNYGAVVSLWAPVVLVYFMDTQIWYAIYSTLYGGIVGAFDRLGEIRTLGMLRSRFQSLPGAFNTCLVPSDKTKKRGFSLSKRFAEVPASRRSEAAKFAQIWNEVICSFREEDLISDGQGLHWMDMLLVPYSSDPSLKIIQWPPFLLASKIPIALDMAAQFRSRDADLWKRICADEYMKCAVIECYESFKYLLNILVVGENEKRMIGIIIKEIESNISKNTFLANFRMSPLPTLCKKFVELVEILKDGDPSKRDTVVLLLQDMLEVVTRDMMVNEIRELAELGHGNKDSISRNQLFAGTNPKPAIIFPPIVTAQWEEQIRRLYLLLTVKESASDVPTNLEARRRVAFFANSLFMDMPRAPRVRKMLSFSVMTPYYSEETVYSKSDLEMENEDGVSIIYYLQKIFPDEWNNFMERLNCKKESEVWENEENILHLRHWVSLRGQTLCRTVRGMMYYRRALRLQAFLDMASEKEILEGYKAFTVPSEEDKKSQRSTYAQLEAVADMKFTYVATCQNYGNQKRSGDRRATDILNLMVNNPALRVAYIDEVEEGENGKVQKVYYSVLVKAVDTLDQEIYRIKLPGSAKVGEGKPENQNHAIVFTRGEALQTIDMNQDNYLEEAFKMRNLLEEFKEDHGVRPPSILGVREHIFTGSVSSLAWFMSNQETSFVTIGQRVLARPLKVRFHYGHPDVFDRLFHITRGGISKASAGINLSEDIFAGFNSTLRRGNVTHHEYIQVGKGRDVGLNQISLFEAKVACGNGEQTLSRDVYRLGHRFDFFRMLSCYFTTVGFYVSSMIVVITVYVFLYGKLYLSLSGLEEAIIKFARSKGDHALRTVMASQSLVQIGLLMALPMLMEIGLERGFRTALGDMIIMQLQLASVFFTFSLGTKVHYFGRTVLHGGAKYRATGRGFVVRHEKFAENYRMYSRSHFVKGMELMILLIAYEVYGSAASDPATYILFTCSMWFLVASWLFAPFLFNPSGFEWQKIVDDWDDWSKWMNSRGGIGVPANKSWESWWEEEQEHLQYTGFLGRFWETVLSLRFFIYQYGIVYHLHVANGDKSIVVYGLSWLVIAAVIIILKIVSMGRKKFSADFQLMFRLLKLILFIGFIGTLVILFVFLSLTVGDIFASLLAFIPTGWALLGISQALRPAVKALGMWGSVKALGRGYEYMMGLSIFAPVAILAWFPFVSEFQTRLLFNQAFSRGLQIQRILAGGKKNK

SEQ ID NO: 35 - protein, 1933 aa, Vitis vinifera
MGLTRRPSRSSATTTFSTEVFDHEVVPSSLGSIVPILRVATEIEPERPRVAYLCRFYAFEKADRLDPNSSGRGVRQFKTGLLQRLERENSSSLASRVKKSDAREIQSFYQQYYQNYVRALDKGEQADRAQLGKAYQTAGVLFEVLCAVNKTEKVEEVAPEIIAAATDVQEKKEIYAPYNILPLDSAGATQSIMQLEEVKAAVGALWNTRGLNWPTEFERHRQKAGDLDLLDWLRAMFGFQACGRDNVRNQREHLILLLANNHTALHPKPEPLNKACTDLSFELDERAIDAIMDKLFKNYKTWCKFLGRKHSLRLPQGQQEIQQRKMLYMGLYLLIWGEAANVRFMPECLCYIFHNMAYELHGLLAGNVSIVTGENIKPSYGGDDESFLRKVITPLYRVIEKEAKKSKHGKAPHSSWCNYDDLNEYFWSSDCFSLGWPMRDDGDFFKSTRDMVAQGRKGSNRKSGSTGKSYFVETRTFWHIFRSFDRLWTFYILALQAMIIIAWHDNLSLSDIFRTDMLHNLSSIFIPASFLRFLQSILDLILNFPGYHRWKFTDVLRNILKMVVSLAWAVILPLFYVHSFVAPNKIRDVLSRLHEIKGIPTLYVVAVFLYLLPNLLAAVLFIFPMLRRWIENSDWHIIRFLLWWSQPRIYVGRGMHESQFALLKYTIFWALLLCSKFAFSYFIQIKPLVKPTKSIMRINLVHYAWHEFFPQAKKNYGAVVSLWAPVVLVYFMDTQIWYAIYSTLYGGIVGAFDRLGEIRTLGMLRSRFQSLPGAFNTCLVPSDKTKKRGFSLSKRFAEVPASRRSEAAKFAQIWNEVICSFREEDLISDGQGLHWVEWEMDMLLVPYSSDPSLKIIQWPPFLLASKIPIALDMAAQFRSRDADLWKRICADEYMKCAVIECYESFKYLLNILVVGENEKRMIGIIIKEIESNISKNTFLANFRMSPLPTLCKKFVELVEILKDGDPSKRDTVVLLLQDMLEVVTRDMMVNEIRELAELGHGNKDSISRNQLFAGTNPKPAIIFPPIVTAQWEEQIRRLYLLLTVKESASDVPTNLEARRRVAFFANSLFMDMPRAPRVRKMLSFQVWIIVMTPYYSEETVYSKSDLEMENEDGVSIIYYLQKIFPDEWNNFMERLNCKKESEVWENEENILHLRHWVSLRGQTLCRTVRGMMYYRRALRLQAFLDMASEKEILEGYKAFTVPSEEDKKSQRSTYAQLEAVADMKFTYVATCQNYGNQKRSGDRRATDILNLMVNNPALRVAYIDEVEEGENGKVQKVYYSVLVKAVDTLDQEIYRIKLPGSAKVGEGKPENQNHAIVFTRGEALQTIDMNQDNYLEEAFKMRNLLEEFKEDHGVRPPSILGVREHIFTGSVSSLAWFMSNQETSFVTIGQRVLARPLKVRFHYGHPDVFDRLFHITRGGISKASAGINLSEDIFAGFNSTLRRGNVTHHEYIQVGKGRDVGLNQISLFEAKVACGNGEQTLSRDVYRLGHRFDFFRMLSCYFTTVGFYVSSMIVVITVYVFLYGKLYLSLSGLEEAIIKFARSKGDHALRTVMASQSLVQIGLLMALPMLMEIGLERGFRTALGDMIIMQLQLASVFFTFSLGTKVHYFGRTVLHGGAKYRATGRGFVVRHEKFAENYRMYSRSHFVKGMELMILLIAYEVYGSAASDPATYILFTCSMWFLVASWLFAPFLFNPSGFEWQKIVDDWDDWSKWMNSRGGIGVPANKSWESWWEEEQEHLQYTGFLGRFWETVLSLRFFIYQYGIVYHLHVANGDKSIVVYGLSWLVIAAVIIILKIVSMGRKKFSADFQLMFRLLKLILFIGFIGTLVILFVFLSLTVGDIFASLLAFIPTGWALLGISQALRPAVKALGMWGSVKALGRGYEYMMGLSIFAPVAILAWFPFVSEFQTRLLFNQAFSRGLQIQRILAGGKKNK

SEQ ID NO: 36 - protein, 1931 aa, Nicotiana alata
MTNPARPAEGMDPQTPGAGGAGPSSLTRRPSRSAATTTFSMEVFDNEVVPSSLQSIAPILRVAREIQNERPRVAYLCRFYAFEKAHRLDPTSSGRGVRQFKTNLFQRLERDNASSLASRVKKTDAREIESFYKQYYEQYVVSLNKGEQADRAQLGKAYQTAGVLFEVLCAVNKSEKVEEVAPEIIAAANDVQAKKEIYAPYNILPLDSAGASQSIMQLEEVKAAVSALSNTRGLNWPASFEQQRQKAGELDVLDWLRAMFGFQRDNVRNQRENLILLLANIHIRLIPKAEPLNKLDDRAVDALMNKLFKNYKTWCKYLGKKHSLRLPQAPQEAQQRKILYMGLYLLIWGEAANIRFMPECLCYIFHNMAYELHGLLAGNVSIVTGENIKPSYGGDDESFLRKVITPIYRVIDKEAKKSKNGKAPYSTWCNYDDLNEFFWSQDCFSLGWPMRDDGDFFKSTRDTTQGKGASTKKPGKMGKSYFVETRSFWHIFRSFDRLWTFFLLALQAMVIFAWSDISVLDIFRKDSLYNLSSIFITAAFLRFLQSILDLVLNFPGYHRWKFTDVLRNVLKIIVSLAWSIILPLFYVQESNSELFTKIRNSLTFLDKMKGIPPLYLMAVAVYLLPNLLTAALFIFPMLRRWIENSDWLVVRFLLWWSQPRIYVGRGMHESQFALIKYTLFWVLLLCAKFAFSYFIQIKPLIKPTKMIMDINRVQYAWHEFFPDARSNYGAVLSLWAPVILVYFMDAQIWYAIFSTLCGGVIGAFDRLGEIRTLDMLRSRFQSLPGAFNSYLVPSDKTDKKGFSLSKSFNEVSPSKRSEAAKFAQLWNEFICSFREEDLISDREMDLLLVPYSSDPSLKVIQWPPFLLASKIPIALDMASQFRSRDADLWKRICADEYMKCAVIECYESFKLVLNALVVGETEKRIIGIIIKEVENNISKSTFLANFRTGPLQNPCTKFVDLLEILRDGDPSKRNNVVIALQDMLEIVTRDMMVNEIGELVELGHNGRDSGKQLFANTDSRTAIAFPPPVTAQWEEQIRRLYLLLTVRESAVEVPTNLEARRRIHFFTNSLFMEMPRAPRVRKMLSFSVMTPYYSEETVYSKGDLEMENEDGVSIIYYLQKIYPDEWNNFMERLGCKKESEVWENDENILQLRHWASLRGQTLCRTVRGMMYYRRALKLQAFLDMASEGEILEGYKAVTVPSEEDKKSQRSLYAQLEAVADMKFTYVATCQNYGNQKRNGDRRATDILNLMVNNPSLRVAYIDEVEEREGGKAQKVYYSVLVKAVDNLDQEIYRIKLPGAAKIGEGKPENQNHAIIFSRGEALQTIDMNQDNYLEEALKMRNLLEEFNEDHGVRPPTILGVREHIFTGSVSSLAWFMSNQETSFVTIGQRVLARPLKVRFHYGHPDVFDRIFHITRGGISKSSRGINLSEDIFAGFNSTLRRGNITHHEYIQVGKGRDVGLNQISLFEAKVACGNGEQTLSRDVYRLGHRFDFFRMLSCYFTTTGFYISSMLVVLTVYAFLYGKLYLALSGLEQSIVKVARSKGDDALKAAMASQSVVQLGLLMALPMVMEIGLERGFRTAAGDIIIMNLQLAAVFFTFSLGTKLHYFGRTILHGGAKYRATGRGFVVRHEKFAENYRMYSRSHFTKALEILILLVAYQIYGTAVTDSVAFLLLSGSMWFLVVSWLFAPFLFNPSGFEWQKIVDDWEDWAKWISNHGGIGVPATKSWESWWDEEQEHLQYSGLIGRFCEILLSLRFLLFQYGIVYQLNVANNDKGIIVYGLSWLVIVFVMVVLKIVSMGRKKFSADFQLMFRLLKLFLFIGFIVTLVVLFKFLSLTVGDIFASLLAFLPTGWALLQIAQACRPVVKGIGMWGSVKALARGYEYLMGLVIFAPVAVLAWFPFVSEFQTRLLFNQAFSRGLQIQRILAGGKKHK

SEQ ID NO: 37 - protein, 1923 aa, Arabidopsis lyrata subsp. lyrata
MAQSSTSHDSGPQGLMRRPSRSAATTVSIEVFDHEVVPASLGTIAPILRVAAEIEHERPRVAYLCRFYAFEKAHRLDPSSGGRGVRQFKTLLFQRLERDNASSLASRVKKTDGREVESFYQQYYEHYVRALDQGDQADRAQLGKAYQTAGVLFEVLMAVNKSEKVEAVAPEIIAAARDVQEKNEIYAPYNILPLDSAGASQSVMQLEEVKAAVAALGNTRGLNWPSGFEQHRKKTGNLDLLDWLRAMFGFQRDNVRNQREHLVCLLADNHIRLTPKPEPLNKLDDRAVDAVMTKLFKNYKNWCKFLGRKHSLRLPQAAQDIQQRKILYMGLYLLIWGEAANIRFMPECLCYIFHNMAYELHGLLAGNVSIVTGENIKPSYGGDDEAFLRKVITPIYRVVQKEANKNANGKAAHSDWSNYDDLNEYFWTPDCFSLGWPMRDDGDLFKSTRDTTQGKKGSLRKPGSTGKSNFTETRTFWHIYHSFDRLWTFYLLALQAMIILAFERVELREILRKDVLYALSSIFITAAFLRFLQSVLDVILNFPGFHRWKFTDVLRNILKIVVSLAWCVVLPLCYAQSVSFAPGKLKQWLSFLPQVKGVPPLYIMAVALYLLPNVLAAIMFIFPMFRRWIENSDWHIFRLLLWWSQPRIYVGRGMHESQIALIKYTIFWLLLFCCKFAFSYFLQVRLLVKPTNAIMSIRHVKYKWHEFFPNAEHNYGAVVSLWLPVILVYFMDTQIWYAIFSTICGGVIGAFDRLGEIRTLGMLRSRFQSLPGAFNTYLVPSDKTRRRGFSLSKRFAEVTAARRTEAAKFSQLWNEIISSFREEDLISDREMDLLLVPYTSDPSLKLIQWPPFLLASKIPIALDMAAQFRTRDSDLWKRICADEYMKCAVIECYESFKHVLHTLVIGENEKRIIGIIIKEVESNISKNSFLSNFRMAPLPALCSKFVELVGILKNADPAKRDTLVLLLQDMLEVVTRDMMQNENRELVELGHTNKESGRQLFAGTDAKPAILFPPVATAQWDEQISRLHLLLTVKESAMDVPTNLEAQRRIAFFTNSLFMDMPRAPRVRNMLSFSVLTPYYSEETVYSKNDLEMENEDGVSVVYYLQKIFPDEWTNFLERLGCKDETSVLESEENILQLRHWVSLRGQTLFRTVRGMMYYRRALKLQAFLDMANETEILAGYKAISEPTEEDKKSQRSLYTQLEAVADLKFTYVATCQNYGNQKRSGDRRATDILNLMVNNPSLRVAYIDEVEEREGGKVQKVFYSVLIKAVDNLDQEIYRIKLPGPAKIGEGKPENQNHALIFTRGEALQAIDMNQDHYLEEALKMRNLLEEFNEDHGVRAPTILGFREHIFTGSVSSLAWFMSNQETSFVTIGQRVLASPLKVRFHYGHPDVFDRIFHITRGGISKASRGINLSEDIFAGFNSTLRRGNVTHHEYIQVGKGRDVGLNQISLFEAKVACGNGEQTLSRDLYRLGHRFDFFRMMSCYFTTVGFYISSMIVVLTVYAFLYGRLYLSLSGVEEAIVKFAAAKGDSSLKAAMASQSVVQLGLLMTLPMVMEIGLERGFRTALSDIIIMQLQLAPVFFTFSLGTKVHYYGRTILHGGAKYRATGRGFVVKHEKFAENYRMYSRSHFVKGMELMVLLICYRIYGKAAEDTVAYALVMGSTWFLVGSWLFAPFFFNPSGFEWQKIVDDWDDWNKWISSRGGIGVPAHKSWESWWEEEQEHLLHSGFFGKFWEIFLSLRYFIYQYGIVYHLNLTKESRMGKQQSIIVYGLSWLVIVAVMIVLKIVSMGRKKFSADFQLMFRLLKLFLFIGSVVIVGMLFHFLKLTVGDIMQSLLAFLPTGWALLQISQVARQLMKAVGMWGSVKALARGYEYIMGVVIFMPVTVLAWFPFVSEFQTRLLFNQAFSRGLQIQRILAGGKKQK

SEQ ID NO: 38 - protein, 1854 aa, Cabomba caroliniana
  misc_feature (686)..(686): Xaa can be any naturally occurring amino acid
PLFYAFEKAHRLDPTSTGRGVRQFKTALLQRLEKDNSSSLAARLKKSDAREIESFYQQYYEHYVRALDKGEQADRVQLGKAYQTAGVLFEVLCAVNKTEKVEQVAPEIIAAAKDVQEKKEIFTPYNILPLDAAGASSSIMQLEEIKAAVAALWNTRGLNWPSSFEQHKQKSDLDILDWLRAMFGFQKDNVRNQREHLILLLANVHIRLVPKPEPLNKLDERAVDEVMNKLFKNYKTWCKFLGRKNSLLLPQSQPEIQQRKILYMGLYLMIWGEAANIRFMPECLCYIFHNMAYELHGLLAGNVSIVTGENIKPSYGGDDESFLRKVVTPIYRVIETEASKSRNGTAPHSAWCNYDDLNEYFWSAECFSLGWPMRDDDDFFKSREAKPASQTGQKSSKGHDKGTGKTNFVETRSFWHIFRSFDRLWTFYVLALQAMIIVAWSGYSPLEIYRQDLLYSLSSIFITAAILRLLQGILDIILNFPGYHRWQLTSVLRNVLKIIVSMAWVVILPLCYIDSVKSSLPFLNQLQSWLHETKGGGVPPLYVMAVALYLLPNLLAGILFIFPMLRRWIENSDWHIIRFLLWWSQPRIYVGRGMHESQFELFKYTLFWVLLLICKFTFSYFVQIKPLVKPTKDIMSVRHVQYAWHEFFPDARYNIGAALSLWAPVIMVYFMDTQIWYAIFSTIYRXVSGAFGRLGEIRTSGMLRSRFNSLPSSFQCMLSALCKDRRRGFSLAKRFAEASPSRSTEAAKFAQLWNEVITSFREEDLISDREMDLMLVPYSSDPSLKLIQWPPFLLASKIPIALDMAVHFRSRDADLWKRICSDEYMRCAVIECYESLKYILDVLVVGETEKRIINIIIKEVELNIAKHTFLTSFRTSALPKLCKKFVELVEILKGNDPAKRDTVVLLLQDKLEVVTRDMMTNEIRELVDLGHGYKDSFQGRCDLANASQSGKQLFAGNDPKPAVNFPPVVTPQWEEQIKRLYLLLTVKESATDVPTNLEARRRVAFFSNSLFMDMPRAPRVRKMLSFSVMTPYYSEETVYSKTDLELENEDGVSIIFYLQKIFPDEWNNFMERLNCKKESEVWSNEENVLHLRHWASLRGQTLCRTVRGMLYYRRALKLQAFLDMASESEILEGYKAATDPTNEEKRSQRSLSAQLEAIADMKFTYVATCQIYGSQKQSGDRRATDILNLMVNYPSLRVAYVDEVEERENGRVQKVYYSVLVKAVDKRDQEIYRIKLPGAPKIGEGKPENQNHAIVFSRGEALQTIDMNQDNYLEEAFKMRNLLEEFNEDHGVRSPTILGVREHIFTGSVSSLAWFMSNQETSFVTIGQRVLADPLKVRFHYGHPDVFDRIFHITRGGISKSSRGINLSEDIFAGFNSTLRRGNVTHHEYIQVGKGRDVGLNQISLFEAKVACGNGEQVLSRDIYRLGHRFDFFRMLSCYFTTVGFYISSMMVLLVVYIFLYGKLYLSLSGVENSLERHARARGDDPLKAALASQSLVQMGLLMALPMLMEIGLERGFRTALSDMIIIQLQLCAIFFTFSLGPKSHYFGRTILHGGAKYRATGRGFVVRHEKFAENYRLYSRSHFVKGLELMILLLAYAIYGSAAPDSFAYMLLTMSMWFLAVSFLFAPFLFNPSGFEWQKIVEDWDDWNKWMSNRGGIGVPGNKSWESWWEEEQEHLQYTGLSGRLWEMVLPFRFFVYQYGIVYHLHIANRNTGIVVVSMGRKKFSADFQLMFRLLKLCLFIGCIGAIAVLLTFLNLTVGDIFAGLLAFMPTAWALLQISQACRPLMKGLGLWGSVKALARGYEYLMGLIIFTPVAVLAWFSFVSEFQTRLLFNQAFSRGLQISRILAGGKKQN

SEQ ID NO: 39 - protein, 1844 aa, Selaginella moellendorffii
MANGAPLASPGSSGRRLSRTYTNGMFSGEVLDSEVVPSSLAPIATILRVANEIEPERPRVAYLCRFYAFEKAHRLDPTSSGRGVRQFKTALLQRLEKDNERSIRSRVKRSDAREIQSFYQQYYEQYVKALDGAEHADRAQLAKAYQTAGVLFEVLCAVNKTEEVAPEIIAMGRDIKEKKEIYVPYNILPLDVAGSSQAIMQLPEIKAAVDALRNIRGLPWSAATKQSNKDVIDWLKEKFGFQKDNVSNQREHLILLLANVHTRIQSKTETINKSYVGLLSPFFFLTTIIMCSLPDIQQDIQQRKLLYMGLYLLIWGEAANLRFMPECLCYIFHNMALELHGMLAGNVSFVTGENIKPAYGGEEESFLRKVVTPIYEIIQKEAASNECGTATHSSWRNYDDLNEYFWSDHCFRLGWPMRADSDFFVPPLTTTPFQTISKKPVTRKLNKIGFVEIRSFWHIFRSFDRMWTFYILCLQAMIILAWSKTNSPSDIFEDKMLKKLSSIFITASILRLLQSVLDIAFTFKASRNMRFTGMLRLVLKFAISLAWVITLSTLYAHSWEPNGLMKSVKNWLGQNWRNPSLYTAALVLYLLPNFLGAAFFVFPLLRRWIENSNWRIVRLMLWWSQVPLYVGRGMHEDQFTLFKYTMFWILLVISKLLFSYYVQIKPLVEPTKRIMGVRQIVYTWHELFPNAKKNIAAVLSLWSPVILIYFMDTQIWYAIYSTLFGGILGAFRRLGEVIQGRTGNKLQDFLSFGMKSSLVFVKRTLSTTGKEMNLMLVPYSSDPNLSIVQWPPFLLASKIPVALQMAAEYRGKDNIDLWRKIKADDYRHCAVEECYEAFKAVIKTIIRNEPDKRIIEDIIRTVERDIQANTFLHHFKLSALPSLASKFVRLVELLARPDPNARDTVILLLQDMYEVVTKDMMVEEVELKNTKHSNSTNQLFDSVLYPPPATDAWFEQVNRLHLLLTVKESAMDVPVNLEARRRIAFFTNSLFMDMPRAPRVRKMLPFSVLTPYYSEDIVFTKEQLHLENEDGVSILFYLQKIYPGKRVSDADAWGNEEFEMQLRHWASFRGQTLLRTVRGMMYYRRALELQAFLDMASDDEILEGYKVIGCSSKETKKSQRSVWAQLQAVADMKFTYVATCQIYGLQKRSGDQRATDILNLMLKHPSLRVAYIDEVEETQKDNKSKKVYYSVLVKAVDGLDQEIYRIKLPGPAKLGEGKPENQNHAIIFTRGEALQTIDMNQDNYLEEAFKMRNLLEEFHEDHGVRPPSILGVREHIFTGSVSSLAWFMSNQETSFVTIGQRVLANPLKVRFHYGHPDVFDRLFHITRGGISKASKVINLSEDIFAGFNSTLRRGNVTHHEYIQVGKGRDVGLNQITLFEAKVANGNGEQTLSRDIYRLGHRFDFFRMMSCYFTTVGFYVNALIVVLTVYVFLYGRLYLSLSGMEKSLLKVANMKKDVSLQAALASQSLVQLGLLMALPMIMEIGLERGFRTAISDFIIMQLQLASVFFTFSLGTKVHYFGRTILHGGAKYRATGRGFVVRHERFAENYRLYSRSHFTKALELMILLIVYVAYGSSGNGAVAYMFITASMWFLVVTWLFAPFLFNPSGFEWQKIVEDWDDWNRWIANSGGIGIAAVKSWQSWWDEEHSYLNHTGLRGRIMESLLAIRFFLYQYGLVYHLNITSGHKNILIYALSWLVIIGILIVLKIVSMGRRRFSGDFQLMFRLLKGMLFMGFVSIIIILFVVVGLTVGDLFVTLLAFLPTGWALLQIGMACRPLVESMGFWGSVRALARSYEFFMGLLIFTPVAILAWFPFVSEFQTRLLFNQAFSRGLQISRILAGRKKLGE

SEQ ID NO: 40 - protein, 1906 aa, Populus trichocarpa
MSNLEPSGSQMLSRRPSRSAATTTFSLEVFDNEVVPSSLGSIAPVLRIAAEIEHERPRVAYLCRFYAFEKAHRLDPNSSGRGVRQFKTSLLQRLERDNNSSLASRVKKTDAREIESFYQQYYEHYVRALDQGEQADRAQLGKAYQTAGVLFEVLCAVNKTEKVEEVAPEIIAAARDVQEKKEIYAPFNILPLDSAGASQSIMQLEEVKAAVAALWNTRGLNWPTAFDPQRQKAGDLDILDWLRAIDNVRNQREHLILLLANKHIRLNPKPEPISKLDDRAVDEVMNKLFKNYKTWCKFLGRKHSLRLPQGQPEIQQRKILYMGLFLLIWGEAANVRFMPECLCYIFHNMAYELHGLLAGNVSIVTGENIKPSYGGDDEAFLRKVITPIYHVIEKEANKSKNGKASHSQWCNYDDLNEYFWSSDCFSLGWPMRDDGSFFTSTRDVGKKASSEKPRSTGKAYFVETRTFWHIFRNMGLLLQAMIIIAWSGVSILNIVQKDVLYQLSSIFITAACLRLLQSILDLVLNFPGFHKWKFTDVLRNVLKIIVSLAWAIILPLCYVHSFKVAPDKIKDLLSFFKEVKDIPALYLLAVAVYMLPNILAAALFIFPMLRRWIENSDWLIIRFLLWWSQPRIYVGRGMHESQFVLIKYTVFWLLLLCSKIAFSYFVQIKPLVKPTKAIMNIRNVDYEWHEFFPNAKNNYGAVLSLWLPVILVYFMDTQIWYSIFSTIYGGFAGAFDRLGEIRTLGMLRSRFQSLPGAFNTYLVPSDKKRKKGFSFSKRFSEVGLIYYNVIPVRLLQAREVKLPNLLSYGMKEMDLLLVPYTSDPSLKLIQWPPIMLASKIPIALDMAVQFRSRDADLWKRICADEYMKCAVIECYESFKHVLNILVVGEIEKRILSIIFKEVESNISKNTLLTNFRMGPLPALCNKFVELVILLKDADPSKQNTVVLILQDMLEVFTNDMMVNENRELVDLGQSGKDSGRQVFSGTDTKPAIMFPPVVTAQWEEQIRRIHLLLTVNEFANDVPTNLEARRRISFFTNSLFMDMPRPPRVRKMLSFSVLTPYYSEETVYSKSDLEMENEDGVSIIYYLQKIYPDEWNNFMERINCKKESEVWENEENILQLRHWGSLRGQTLCRTVRGMMYYRRALRLQAFLDMAKESEILEGYKAITDPTEEDKKSQRSVSAQIEAVADMKFTYVATCQNYGNQKRSGDRRATDILNLMVNNPSLRVAYIDEVEEREREGGKVQKVYYSVLVKAVDNLDQEIYRIRLPGTAKLGEGKPENQNHAIIFTRGEALQAIDMNQDNYLEEALKMRNLLEEFNEDHGVLPPTILGVREHIFTGSVSSLAWFMSNQETSFVTIGQRVLARPLKVRFHYGHPDVFDRIFHVTRGGISKASHGINLSEDIFAGFNSTLRRGNVTHHEYIQVGKGRDVGLNQISLFEAKVACGNGEQTLSRDIYRLGHRFDFFRMLSCYYTTIGFYVSSMIVVLTVYAFLYCKLYLSLSGLEESIIKYARARGNDPLKAAMASQSLVQIGFLMALPMVMEMGLERGFRTALGDIIIMQLQLASVFFTFSLGTKVHYFGRTILHGGAKYRATGRGFVVRHQKFAENYRMYSRSHFVKGLELLILLICYKIYGKAASGVGFALVTASMWFLVTSFLFAPFLFNPSGFEWQKIVDDWDDWSKWISSQGGIGVPANKSWESWWDEEQEHLQHTGFLGRFWEIFLSLRFFIYQYGIVYQLKAVKESTPGRSRSAIVYGLSWLVIVAMMIILKIVSMGRKKFSADFQLMFRLLKLFLFIGSVITLVILFTTLHLTVGDIFQSLLAFLPTGLAILQIAQACRPVVKGLKMWGSVKALARGYEYMMALVIFAPVAVLAWFPFVSEFQTRLLFNQAFSRGLQIQRILAGGKKNK

SEQ ID NO: 41 - protein, 1915 aa, Selaginella moellendorffii
MTTRLPRTFTTGTFPTEFDSEVVPSSLGPIAAILRVANEVELDSQRVAYLCRFYAFERAHYDDPSSSGRGVRQFKTALLQRLEKDEEPSRLARRARSDAREMQQFYQNYYDKYVKALEADHQDRASLAKAYQTAGILFDVLTSVTRQDGAEVDSEMQAMNTDVTKKKKDIKHYNILPLDAAGASQAIMKLEEVRAAHDAIANVRGLPKRKEAPSDILEWLQVMFGFQKDNVANQREHLILLLANVHVSLDPEPSPLYKLDQRATEIVMKRMFKNYRTWCKFLGRSDKLELPEIQLEVQQRMILYMALYLLIWGEAANVRFMPECLCYIFHHMASELSGMLSGRVSYVTGENIKPAYGSEDEAFLKKVVTPIYNVIFKKESNRNESGGKPHSSWRNYDDLNEYFWSKTCFRLGWPMRKDDEFFVGAAEEAHSRSSKLARFLPRKPSCLKTNFVEARSFWHLFRTFDRMWTFFILWLQAMIIIAWNGSGSLGALFEGSVFKKVLSVFITAAVLRFFQALLDIIFSFKALHSLGYVGSIRLVLKVLVSAFWIVILSTSYVHSWEHPTGLTRTIKNWLGHNGGPSVYLVAVILYLVPNAIAAIFFLLPCVRRVAEESDAIPVRILLWWSQPPCYIGRGMHEEPLHLFSYTFFWIVLITCKLLFSYYVEIKPLVEPTKFILDFTNVRFAWHEFFPHARGNIGVLIALWTPVILVYFMDIQIWYSIMSTIWGGIVGAFMRLGEIRTLSMLRSRFRALPTTFNWNLIPLESSVKRKYQILRKFKAFEHNKLEEARFAHLWNAVVESLREEDFIDDKEKELMLLPYSADPYPNNNIIQWPPFLLASMAPMAIEMAKEYAEVQGENVEDARLWNKIKENEYMRCAVEECYEFLKNILLRVVTGETEKRLIHDLLKELGNRKAEGKLLENFRMNDLPLLAGHFVRFLEFLPDPSDTARDKVVLLLQDMLEVFMHDMMVDDTREKFESSHGLNMKPTENQSVMGGKGKIQFFAGKDSILYPLPEDHAWSEQIKRVLLLLTETESAMDVPKNLDARRRITFFTNSLFMKMPPAPRVRKMIPFSVLTPFYEEEVLYSKNVIEEPNEDGVSILFYLQNVYPDEWNKFLERVNCTTEEEVEEAALRDWTSYRGQTLSRTVRGMMYYRTALELQAFLDLAPDEDVYTGFKEVSKRRKEEKGQDSFWAKLDAIVDMKFTFVATCQKFGQQKHSKDLKEASKAQDIQKLMTKYPSLRVAYVLEEEPSKGKPQKSYYSVLSKAVDGRDEEIYKIRLPGPVNIGEGKPENQNHAIIFTRGLGLQTIDMNQENYLEEAFKVRNLLEEFKSRHGARFPTILGVREHIFTGSVSSLAWFMSNQETSFVTIGQRVLATPLKVRFHYGHPDVFDRIFHITRGGVSKASKGINLSEDIFAGFNSTLRRGLVTHHEYIQVGKGRDVGLNQISIFEAKVANGNGEQTLSRDVYRLGHRFDFFRMLSFYITTVGYYFSTMIVILTVYVFLYGRLYLALSGLERSFVRAAQQNTDSALQSALASQSLIQLGLLMALPMVMEIGLERGFRMALSDLIVMQLQLASVFFTFTLGSKVHYYGRTIFHGGAKYRATGRGFVVRHEKFPDNYRLYSRSHFVKGFELMILLIIYDVYGSQTRNAVSYVLITFSMWFLVGTWLFSPFLFNPSGFEWQKIVEDWNDWNKWISSKGRIGVPANKSWESWWEEEQDHLQNTGFRGRVFEVILALRFVLYQYGIVYQLNIMRGNKSLSMYGLSWVVICVVLFTLKAVSLGRKKFKANFQLVFRMLKGVIFVAVLSVIAVLFRFAHLTVGDLFASILAFVPTGWGLLQIFQACRPVIVTYGMWDSVQALARTYEYVMGLLLFAPVAILAWFPFVSEFQTRLLFNQAFSRGLQISRILAGKRKKVADD

SEQ ID NO: 42 - protein, 1845 aa, Selaginella moellendorffii
MASPGSSGRRLSRTYTNGMFSGEVLDSEVVPSSLAPIATILRVANEIEPERPRVAYLCRFYAFEKAHRLDPTSSGRGVRQFKTALLQRLEKDNERSIRSRVKRSDAREIQSFYQQYYEQYVKALDGAEHADRAQLAKAYQTAGVLFEVLCAVNKTEEVAPEIIAMGRDIKEKKEIYVPYNILPLDVAGSSQAIMQLPEIKAAVDALRNIRGLPWSAATKQSNKDVIDWLKEKFGFQKDNVSNQREHLILLLANVHTRIQSKTETMNKSYVGLLSPFFFLTTIIMCSLPDIQQDIQQRKLLYMGLYLLIWGEAANLRFMPECLCYIFHNMALELHGMLAGNVSFVTGENIKPAYGGEDESFLRKVVTPIYEIIQKEAASNECGTATHSSWRNYDDLNEYFWSDHCFRLGWPMRADSDFFVPPLTTTPFQTISKKPVTRKLNKIGFVEIRSFWHIFRSFDRMWTFYILCLQAMIILAWSKTNSPSDIFEDKMLKKLSSIFITASILRLLQSVLDIAFTFKASRNMRFTGMLRLVLKFAISLAWVITLSTLYAHSWEPNGLMKSVKNWLGQNWRNPSLYTAALVLYLLPNFLGAAFFVFPLLRRWIENSNWRIVRLMLWWSQVPLYVGRGMHEDQFTLFKYTMFWILLVISKLLFSYYVQIKPLVEPTKRIMGVRQIVYTWHELFPNAKKNIAAVLSLWSPVILIYFMDTQIWYAIYSTLFGGILGAFRRLGEVIQGRTGNKLQDFLSFGMKSSLVFVKRTLSTTGKEMNLMLVPYSSDPNLSIVQWPPFLLASKIPVALQMAAEYRGKDNIDLWRKIKADDYRHCAVEECYEAFKAVIKTIIRNEPDKRIIEDIIHTVERDIQANTFLHHFKLSALPSLASKFVRLVELLARPDPNARDTVILLLQDMYEVVTKDMMVEEVELKNTKHSNSTNQLFDSVLYPPPATDAWFEQVNRLHLLLTVKESAMDVPVNLEARRRIAFFTNSLFMDMPRAPRVRKMLPFSVLTPYYSEDIVFTKEQLHLENEDGVSILFYLQKIYPGKRVSDADAWGNEEFEMQLRHWASFRGQTLLRTVRGMMYYRRALELQAFLDMASDDEILEGYKVIGCSSKETKKSQRSVWAQLQAVADMKFTYVATCQIYGLQKRSGDQRATDILNLMLKHPSLRVAYIDEVEETQKDNKSKKVYYSVLVKAVDGLDQEIYRIKLPGPAKLGEGKPENQNHAIIFTRGEALQTIDMNQDNYLEEAFKMRNLLEEFHEDHGVRPPSILGVREHIFTGSVSSLAWFMSNQETSFVTIGQRVLANPLKVRFHYGHPDVFDRLFHITRGGISKASKVINLSEDIFAGFNSTLRRGNVTHHEYIQVGKGRDVGLNQITLFEAKVANGNGEQTLSRDIYRLGHRFDFFRMMSCYFTTVGFYVNALIVVLTVYVFLYGRLYLSLSGMEKSLLKVANMKKDVSLQAALASQSLVQLGLLMALPMIMEIGLERGFRTAISDFIIMQLQLASVFFTFSLGTKVHYFGRTILHGGAKYRATGRGFVVRHERFAENYRLYSRSHFTKALELMILLIVYVAYGSSGNGAVAYMFITASMWFLVVTWLFAPFLFNPSGFEWQKIVEDWDDWNRWIANSGGIGIAAVKSWQSWWDEEHSYLNHTGLRGRIMESLLAIRFFLYQYGLVYHLNITSGHKNILIYALSWLVIIGILIVLKIVSMGRRRFSGDFQLMFRLLKGMLFMGFVSIIIILFVVVGLTVGDLFVTLLAFLPTGWALLQIGMACRPLVESMGFWGSVRALARSYEFFMGLLIFTPVAILAWFPFVSEFQTRLLFNQAFSRASRSLGSLRAGRNSVNETSTISP

SEQ ID NO: 43 - protein, 1896 aa, Selaginella moellendorffii
MTTRLPRTFTTGTFPTEFDSEVVPSSLGPIAAILRVANEVEQDSQRVAYLCRFYAFERAHYDDPSSSGRGVRQFKTALLQRLEKDEEPSRLARRERSDAREMQRFYQNYYDKYVKALEADHQDRASLAKAYQTAGILFDVLTSVTRQDGAEVDSEMQAMNTDVTKKKKDIKHYNILPLDAAGASQAIMKLEEVRAAHDAIANVRGLPKRKEAPSDILEWLQVMFGFQKDNVANQREHLILLLANVHVSLDPEPSPLYKLDQRATEIVMKRMFKNYRTWCKFLGRSDKLELPEIQLEVQQRMILYMALYLLIWGEAANVRFMPECLCYIFHHMASELSGMLSGRVSYVTGENIKPAYGSEDEAFLKKVVTPIYNVIFKKESNRNESGGKPHSSWRNYDDLNEYFWSKTCFRLGWPMRKDDEFFVGAAEEAHSRSSKTNFVEARSFWHLFRTFDRMWTFFILWLQAMIIIAWNGSGSLGALFEGSVFKKVLSVFITAAVLRFFQALLDIIFSFKALHSLGYVGSIRLVLKVLVSAFWIVILSTSYVHSWEHPTGLTRTIKNLLGHNGGPSVYLVAVILYLVPNAIAAIFFLLPCVRRVAEESDAIPVRILLWWSQPPCYIGRGMHEEPLHLFSYTFFWIVLITCKLLFSYYVEIKPLVEPTKFILDFTNVRFAWHEFFPHARGNIGVLIALWTPVILVYFMDIQIWYSIMSTIWGGVVGAFMRLGEIRTLSMLRSRFRALPTTFNWNLIPLESSVKRKYQILRKFKAHNKLEEARFAHLWNAVIESLREEDFLDDKEKELMLLPYSADPYPSNNIIQWPPFLLASMAPMAIEMAKEYAEVQGENVEDARLWNKIKENEYMRCAVEECYEFLKNILLRVVTGDTEKRLIHDLLKELEDRKAEGKLLENFRMNDLPLLAGHFVRFLEFLDKPDPSDTARDKVVLLLQDMLEVFMHDMMKFESSHGLNMKPTDNQSVMGGKGKIQFFAGKDSILYPLPEDHAWSEQIKRVLLLLTETESAMDVPKNLDARRRITFFTNSLFMKMPPAPRVRKMIPFSVLTPFYEEEVLYSKNVIEEPNEDGVSILFYLQNVYPDEWNKFLERVNCSTEEEVEEAALRDWTSYRGQTLSRTVRGMMYYRTALELQAFLDLAPDEDVYTGFKEVSKRRKEEKGQDSFWAKLDAIVDMKFTFVATCQKFGQQKHSKDLKEASKAQDIQKLMTKYPSLRVAYVLEEEPSKGKPQKSYYSVLSKAVDGRDEEIYKIRLPGPVNIGEGKPENQNHAIIFTRGLGLQTIDMNQENYLEEAFKVRNLLEEFKSRHGARFPTILGVREHIFTGSVSSLAWFMSNQETSFVTIGQRVLATPLKVRFHYGHPDVFDRIFHITRGGVSKASKGINLSEDIFAGFNSTLRRGLVTHHEYIQVGKGRDVGLNQISIFEAKVANGNGEQTLSRDVYRLGHRFDFFRMLSFYITTVGYYFSTMIVILTVYVFLYGRLYLALSGLERSFVRAAQQNTDSALQSALASQSLIQLGLLMALPMVMEIGLERGFRMALSDLIVMQLQLASVFFTFTLGSKVHYYGRTIFHGGAKYRATGRGFVVRHEKFPDNYRLYSRSHFVKGFELMILLIIYDVYGSQTRNAVSYVLITFSMWFLVGTWLFSPFLFNPSGFEWQKIVEDWNDWNKWISSKGRIGVPANKSWESWWEEEQDHLQNTGFRGRVFEVILALRFVLYQYGIVYQLNIMRGNKSLSMYGLSWVVICVVLFTLKAVSLGRKKFKANFQLVFRMLKGVIFVAVLSVIAVLFRFAHLTVGDLFASILAFVPTGWGLLQIFQACRPVIVTYGMWDSVQALARTYEYVMGLLLFAPVAILAWFPFVSEFQTRLLFNQAFSRGLQISRILAGKRKKVADD

SEQ ID NO: 44 - protein, 1910 aa, Oryza sativa Japonica Group
MTGPRGGGGEDPPRTSSGAAASASASSGVPNEPLTPTSMLMSGQQAGLNRRGSRSAAMATFSMEVFDNEVVPSTLSSIAPILRVAAEIEPERPRVAYLCRFYAFEKAHRLDQNSVGRGVRQFKTALLQRLEKDNSPSLAKRVKKTDAREIESFYQQYYENYVRALDKGEQADRAQLGKAYQTAGVLFEVLCAVNKNEKVEEVNPEIVRLHRDVQEKKDIYTPFNILPLDAASASQSIMQMEEIKAAVAALRNTRGLTWPSTFEPERQKGGDLDLLDWLRAMFGFQRDSVRNQREHLILLLANVHIRLEPKPEPLSKACSFATFYFADLTIWISMWIMKSPQGAQPQEIQQRNILFLGLYLLIWGEAANIRFMPECLCYIFHNMAYELNGLLAGNVSIVTGENIRPSYGGDEEAFLKKVVTPIYRVIKKESGKSKHGKTPHSAWCNYDDLNEYFWTTDCFSLGWPMRDDGDFFKSVHDSRPVTTAGSSSQKGSTKSTGKMNFVETRTFWHIFRSFDRMWTFYLLALQAMLIFAWSDYTLSQILQKDLLYSLSSIFVTAAFLQFLQSILDFVLNFPGHHKCKFLDAMRNILKIIASAAWAVILPFFYISTASKVNLPIKDLDKWFQYVKGVPPLYILAVAVYLIPNILSAALFLLPCFRRWIENSDWRIVRLLLWWSQKRIYVGRGMHESSVSLFKYTLFWILLLCSKFAFSYFVQIKPLIKPTKDIMNVHNIHYEWHEFFPNASYNVGAVMSLWAPVLLVYLMDTQIWYAIFSTISGGVSGALGRLGEVSPSKRTEAAKFAQLWNEVICSFREEDLISDKEMDLLVVPYSSDPSLKLMQWPLFLLASKIPIALDMAAQFRPRDSDLWKRICADEYMKCAVLECYESFKLVLNLLVIGENEKRIIGIIIKEIEANIAKNTFLANFRMSALPVLCKKFVELVSALKERDASKFDNVVLLLQDMLEVITRDMMVNEIRELAEFGHGNKDSVPRRQLFAGTGTKPAIVFPPPISAQWDEQIKRLYLLLTVKESAMDVPTNLEARRRIAFFTNSLFMDMPRAPRVRKMLSFSVMTPYYSEETVYSRNDLDLENEDGVSIIFYLQKIFPDEWNNFLERIGCQRESEVWGNEENVLQLRHWASLRGQTLCRTVRGMMYYKRALKLQAFLDMASESEILEGYKAVADPAEEEKKSQRSLSSQLEAIADMKFTYVATCQIYGNQKQSGDRRATDILNLMVNYPGLRVAYIDEVEERDGEKVQKVFYSVLVKALDNHDQEIYRIKLPGPAKLGEGKPENQNHAIVFTRGEALQTIDMNQDNYLEEALKMRNLLEEFHENHGVRQPTILGVREHIFTGSVSSLAWFMSNQETSFVTIGQRVLANPLKVRFHYGHPDVFDRIFHITRGGISKASCGINLSEDIFAGFNSTLRRGNVTHHEYIQVGKGRDVGLNQISLFEAKVACGNGEQTLSRDIYRLGHRFDFFRMLSCYFTTVGFYISSMMVVIIVYVFLYGRLYLALSGLELAIMKQARMRGNTALQAAMGSQSIVQLGLLMALPMFMEIGLERGFRSALGDFIIMQLQLCSVFFTFSLGTKSHYFGRTILHGGAKYKATGRGFVVRHVKFPENYRMYSRSHFVKGLELMLLLVVYQMYGDVATDSTAYILLTSSMWFLVITWLFAPFLFNPSGFEWQKIVDDWDDWSKWISSRGGIGVPANKAWESWWEEEQEHLQSTGFFGRLSEIILSLRFFIFQYGIMYHLNISAGNKSISVYGLSWLVIVAVVMVLKVVSMGRKKFSADFQLMFRLLKLFLFIGSIGTLAILFTLLHLTVGDIFASFLAFAPTGWAILQISQASKPVVKAFGLWGSVKALSRGYEYLMGILIFVPVAVLAWFPFVSEFQTRLLFNQAFSRGLQISRILAGGKKQS

SEQ ID NO: 45 - protein, 1642 aa, Oryza sativa Japonica Group
MAFEMYGMLVGNVSALTGEYVKPAYGGEKEAFLKKVVTPIYLTIAKEAERSKREKGNHSEWRNYDDLNEYFWSAECFRLGWPMRADADFFCQHLNSPDQRNETTRTEKQKGKVNFVELRSFWHIFRSFDRMWSFFILALQVMVILAWNGGSLGNIFDPVVFKKILSIFITSAILNLGQATLDIIFNWKARRTMEFAVKLRYVLKFTLAALWVVLLPVTYAYTWENPTGIIRAIKGWFGNGQNHPSLFVLAVVIYLSPSLLAAILFLLPFLRRILESSDYKFVRFVMWWSQLTTDQDNVENIVVSYYLRRRPDMTKQNPRLFVGRGMHESAFSLFMYTMFWIALLLIKFAFSYYVEIKPLVEPTKDIMKLPIHTFQWHEFFPKANGNIGVVIALWAPIILVYFMDTQIWYTIFSTLLGGIYGAFQRLGEIRTLGMLRSRFGSIPLAFNACLIPAEESDAKRKKGLKSYLHSRFERKHTDKEKIAARFAQMWNEIITSFREEDLINNKEKELLLVPYVADQALEIMQWPPFLLASKIPIAVDMAKDSNGKDRDLKKRLENDYYFKCAIEECYASFKNIIKDLVQGEPEKRVINTIFAEVEKYIADDKVITDLNMHALPDLYNKFVELVKYLEKNDKNDRDAVIKIFQDMLEVVTRDIMEDQLSSILESSHGGSYQRPEGTTTWDQEYQLFQPAGAIKFPVQFTDAWIEKIKRLELLLTVKESAMDVPSNLEARRRLTFFTNSLFMDMPDAPKVRNMLSFSALTPYYNEPVLFSIKELQEENEDGVSTLFYLQKIYPDEWKNFQQRVEWDEELKENEDKNEELRLWASYRGQTLARTVRGMMYYRKALVLEAFLDMAKHEDLMEGYKAVESTDEQWKLQRSLFAQCEAVADMKFTYVVSCQQYGNDKRAALPNAQDILQLMRTYPSLRVAYIDQVEDRVEEKKMEPAYYSTLVKVALTKDSESTDPVQNLDQKWIKCESSFCDPVKLQHLHFFVFKVIYRIKLPGPAMLGEGKPENQNHAIIFTRGEGLQTIDMNQDNYMEEALKMRNLLQEFLTEHGVRRPSILGVREHIFTGSVSSLAWFMSNQEHSFVTIGQRLLANPLKVRFHYGHPDVFDRIFHLTRGGVSKASRSINLSEDIFAGYNSTLRGGNITHHEYVQVGKGRDVGLNQISKFEAKVANGNGEQTLSRDIYRLGHRFDFFRMLSCYFTTVGFYFSTLLTVVTVYVFLYGRLYLALSGLEEGLLTQRRYIHNHPLQVALASQSLVQLGFLMALPMMMEIGLEKGFGQALSEFIMMNLQLAAVFFTFSLGTKTHYYGRMLLHGGAQYRATGRGFVVFHAKFAENYRLYSRSHFVKGIELLILLIIYQLFGQSYRSTIAYIFVTFSMWFLVLTWLFAPFLFNPSGFEWTKIVDDWSDWNKWISNRGGIGVSPDKSWESWWEIELEHLKYSGTIGLFVEIILSLRFFIYQYGLVYHLNITGDKSILVYLISWLVILVVLLVMKTVSVGRRRFSADFQLFFRLIKFMIFVSFIAILIVLIAILHMTLRDIFVCFLAFLPSGWGILLIAQACKPLARRAGLWGSVRALARAYEIIMGVLLFTPITILAWFPFVSEFQTRMLFNQAFSRGLQISRILGGQKKERERSSRNKD

SEQ ID NO: 46 - protein, 1545 aa, Sorghum bicolor
MAFEMYGMLAGNVSALTGEYVKPAYGGEKEAFLKKVVTPIYHTIAKEAERSKREKGNHSEWRNYDDLNEYFWSADCFRLGWPMRADADFFCQPDERNESTRISKQKGKINFVELRSFWHIFRSFDRLWSFFILALQVMIILAWEGGSLASIFDYAVFKKVLSIFITSAILNLGQATLDIIFNWKARRTMEFAVKLRYVLKFVMAALWVVLLPVTYAYTWENPTGIIRVIKSWFGNGRNHPPLFVVSVVIYLSPSMLSAILFLLPFLRRSLESSDFKLVRFIMWWSQPRLFVGRGMHESAFSLFMYTMFWIALLLIKFAFSYYVEIKPLVEPTKVIMKTPIRTFRWHEFFPREKSNIGVVIALWAPIILVYFMDTQIWYTIFSTLLGGIYGAFQRLGEMEHADKENIAARFAQMWNEIVTSFRDEDLIDNREKELLLVPYVSDQALGVVQWPPFLLASKIPIAVDMAKDSNGKDRDLKKRLENDYYFKCAIEECYASFKNIINDLVQGEPEKRVIKKIFEEVEKCISEDKVIADLNMRALPDLYSKFVELVTYLKENDEKDRSAVIKIFQDMLEVVTRDIFDDQLSILESSHGGSYQKHDDTTAWDKEYQLFQPSGAIKFPLQVTTTDAWLEKIKRLELLLTVKESAMDVPSNLEARRRLTFFTNSLFMDMPDAPKVRNMLSFSALTPYYNEPVLFSIKELEEENEDGVSTLFYLQKIYPDEWKNFKERVGLEEELKESEESEELKEELRLWASYRGQTLARTVRGMMYYKKALNLEAFLDMAKREDLMEGYKAAESVNDEQWKIQQRSLFAQCEAVADMKFTYVVSCQQYGNDKRAALANAQDILQLMRNYSSLRVAYIDEVEDRVGDKKMETAYYSTLVKVALTKDSESADPIQNLDQVIYRIKLPGPAILGEGKPENQNHAIIFTRGEGLQTIDMNQDNYLEEALKMRNLLQEFLTEHGVRRPSILGVREHIFTGSVSSLAWFMSNQEHSFVTIGQRLLANPLKVRFHYGHPDVFDRLFHLTRGGVSKASKSINLSEDIFAGYNSTLRGGNVTHHEYVQVGKGRDVGLNQISKFEAKVANGNGEQTLSRDIYRLGHRFDFFRMLSCYFTTVGFYFSTLLTVVTVYVFLYGRLYLALSGLEEGLSQGRLIHNHPLQVALASQSLVQLGFLMALPMMMEIGLERGFGQALSDLIMMNLQLATVFFTFSLGTKTHYYGRMLLHGGAQYRGTGRGFVVFHAKFAENYRLYSRSHFVKGIELMILLIVYQLFGQSYRSTIAYIFITISMWFLVLTWLFAPFLFNPSGFEWAKIVDDWSDWNKWISNRGGIGVSPDKSWESWWEVEQDHLKYSGTIGRFVEIILAVRFFIYQYGLVYHLHITHDKSILVYLMSWLVIVAVLFVMKTVSVGRRTFSADFQLFFRLIKFLIFVAFTAILIVLIVFLHMTFRDIFVCFLAFLPTGWGILLIAQACKPLARHVGLWGSVRALARAYEIIMGVLLFTPITILAWFPFVSEFQTRMLFNQAFSRGLQISRILGGQKKERSARSKD

SEQ ID NO: 47 - protein, 1245 aa, Medicago truncatula
RNNIGVVVVLWAPIILVYFMDTQIWYAIFSTLFGGIYGAFRRLGEIRTLGMLRSRFQSLPGAFNASLIPEESTDEPRKKGLKATLSRRFTEIPSNKGKKAARFAQLWNQIITSFREEDLINDSEMDLLLVPYWADTQLDLIQWPPFLLASKIPIALDMAKDSNGKDRELTKRIEADNYMSCAVRECYASFKSIIMHLVRGEREKPFIEYMFGEVDSHIEAGTLIKEFRMSALPSLYGQFVQLIQYLLVNNQKDRDQVVILFQDMLEVVTRDIMMEDQDQIFSLIDSSHGGVGHEGMFPLEPEPHHQLFASEGAISFPIEPVTAAWTEKIKRLFLLLTTKESAMDVPSNLEARRRISFFSNSLFMDMPVAPKVRNMLSFSILTPYYTEEVLFSLLDLDSPNEDGVSILFYLQKIFPDEWTNFLQRVKCSSEEELKGNESEELEEELRLWASYRGQTLTRTVRGMMYYRKALELQAFLDMAKDEDLMEGYKAMENSDDNSRGERSLWTQCQAVADMKFTYVVSCQQYGIDKRSGSPRAHDILRLMTRYPSLRVAYIDEVEEPIKNSKKKINKVYYSCLVKAMPKSSSSSEPEQNLDQVIYKIKLPGPAILGEGKPENQNHAIIFTRGEGLQTIDMNQDNYMEEALKMRNLLQEFLKKHDGVRFPSILGLREHIFTGSVSSLAWFMSNQETSFVTIGQRLLANPLRVRFHYGHPDVFDRLFHLTRGGVSKASKVINLSEDIFAGFNSTLREGSVTHHEYIQVGKGRDVGLNQISMFEAKIANGNGEQTLSRDVYRLGHRFDFFRMLSCYFTTVGFYFSTLITVLTVYIFLYGRLYLVLSGLEEGLSAQKAIRDNKPLQVALASQSFVQIGFLMALPMLMEIGLERGFRTALSEFILMQLQLAPVFFTFSLGTKTHYFGRTLLHGGAKYRPTGRGFVVFHAKFADNYRLYSRSHFVKGIELLVLLVVYEIFSHSYRSAVAYILITVSMWFMVGTWLFAPFLFNPSGFEWQKIVDDWTDWNKWISNRGGIGVPPEKSWESWWEEEQDHLQYSGIRGIIVEILLSLRFFIYQYGLVYHLNITKKGSKSFLVYGISWLVIFVILFVMKTVSVGRRKFSANFQLVFRLIKGMIFVTFIAILVILIALPHMTPQDIIVCILAFMPTGWGMLQIAQALKPIVRRAGFWGSVKTLARGYEIVMGLLLFTPVAFLAWFPFVSEFQTRMLFNQAFSRGLQISRILGGQRKERASRSKE

SEQ ID NO: 48 - protein, 1937 aa, Arabidopsis lyrata subsp. lyrata
MASTSGGRAEDGRPPQMQPVRSMSRRMTRAGTMMIDHPNEDESAIDSELVPSSLASIAPILRVANDIEEDNPRVAYLCRFHAFEKAHRMDPTSSGRGVRQFKTYLLHKLEKEEEITEPMLAKSDPREIQLYYQTFYENNIQEGEGKKTPEEMAKLYQIATVLYDVLKTVVPQARIDEKTLRYAKEVERKKEQYEHYNILPLYALGAKTAVMELPEIKAAILAVCNVDNLPRPRFHSASANLDEVGRERGRSFNDILEWLALVFGFQRGNVANQREHLILLLANIDVRKRDLENYVELKPSTVRKLMEKYFKNYRSWCKYLRCESYLRFPPGCDEQQLSLLYISLYLLIWGEASNVRFMPECLCYIFHNMANEVHGILFGNVYPVTGDTYEAGAPDEEAFLRNVITPIYQVLRKEVRRNKMGKASHSKWRNYDDLNEYFWDNRCFRLKWPMNSKADFFIHTDEISPLPNERHDQVSHGKRKPKTNFVEARTFWNLYRSFDRMWMFLVLSLQTMIIVAWHPSGSILAIFYKDVFRNVLTIFITSAFLNLLQATLDLILSFGAWKSLKFSQIMRYITKFLMAAMWAIMLPITYSKSVQNPTGLIKFFSSWVGSWLHQSLYNYAIALYVLPNILAAVFFLLPPLRRIMERSNMRIVTLIMWWAQPKLYIGRGMHEEMFALFKYTFFWVMLLLSKLAFSYYVEILPLVNPTKLIWDMHVVNYQWHEFFPNATHNIGVIISIWGPIVLVYFMDTQIWYAIFSTLFGGIYGAFSHLGEIRTLGMLRSRFKLVPSAFCIKLTPLPLGHAKRKHLDDTVDEEDIARFSQVWNKFILTMRDEDLISDRERDLLLVPSSSGDVSVVQWPPFLLASKIPIALDMAKDFKGKEDVDLFKKIKSEYYMHYAVVEAYETVRDIIYGLLQDESDKRIVREICYEVDVSIQQHRFLSEFRMTGMPLLSDKLEKFLKILLSDYEEDETYKSQIINVLQDIIEIITQDVMVNGHEILERAHFQSGDIESDKKQQRFEQRFEKIDLRLTQNVSWREKVVRLLLLVTVKESAINIPQSLEARRRMTFFANSLFMNMPDAPRVRDMLSFSVLTPYYKEDVLYSEEELNKENEDGITILFYLQRIYPEEWSNYCERVNDLKRNLSEKDKAEQLRQWVSYRGQTLSRTVRGMMYYRVALELQCFQEYTGENATNGGFLPSESNEDDRKAFTDRARALADLKFTYVVSCQVYGNQKKSSESRDRSCYNNILQLMLKYPSLRVAYIDEREETVNGKSQKVFYSVLLKGCDKLDEEIYRIKLPGPPTEIGEGKPENQNHAIIFTRGEALQTIDMNQDNYFEESFKMRNVLQEFDEGRRGKRNPTILGLREHIFTGSVSSLAWFMSNQETSFVTIGQRVLANPLRVRFHYGHPDIFDRIFHITRGGISKASKIINLSEDIFAGYNSTLRGGYITHHEYIQAGKGRDVGMNQISFFEAKVANGNGEQTLSRDVYRLGRRFDFYRMLSFYFTTVGFYFSSMITVLTVYVFLYGRLYLVLSGLEKEILQSATVHQSNALEQALAAQSVFQLGFLMVLPMVMEIGLEKGFRTALGDFIIMQLQLASVFFTFQLGTKAHYFGRTILHGGSKYRATGRGFVVFHAKFAENYRLYSRSHFVKGLELVILLVVYQVYGTSYRSSSTYLYITFSMWFLVTSWLFAPFIFNPSGFEWQKTVDDWTDWKRWMGNRGGIGIVLDKSWESWWDIEQEHLKHTNLRGRVLEILLALRFLLYQYGIVYHLNIAHRDTTFLVYGLSWAVLLSVLLVLKMVSMGRRKFGTDFQVMFRILKVLLFLGFLSIMTLLFVVCGLTVSDLFASILAFLPTGWALLLIGQALRSVFKGLGFWDSVKELGRAYEYIMGLVIFTPIAVLSWFPFVSEFQTRLLFNQAFSRGLQISMILAGKKDKDTPSTK

SEQ ID NO: 49 - protein, 1947 aa, Artificial Sequence
  CALS3 with R84K substitution
MSATRGGPDQGPSQPQQRRIIRTQTAGNLGESFDSEVVPSSLVEIAPILRVANEVESSNPRVAYLCRFYAFEKAHRLDPTSSGKGVRQFKTALLQRLEREHDPTLMGRVKKSDAREMQSFYQHYYKKYIQALHNAADKADRAQLTKAYQTANVLFEVLKAVNLTQSIEVDREILEAQDKVAEKTQLYVPYNILPLDPDSANQAIMRYPEIQAAVLALRNTRGLPWPEGHKKKKDEDMLDWLQEMFGFQKDNVANQREHLILLLANVHIRQFPKPDQQPKLDDQALTEVMKKLFKNYKKWCKYLGRKSSLWLPTIQQEMQQRKLLYMALYLLIWGEAANLRFMPECLCYIYHHMAFELYGMLAGNVSPMTGENVKPAYGGEEDAFLRKVVTPIYEVIQMEAQRSKKGKSKHSQWRNYDDLNEYFWSVDCFRLGWPMRADADFFCLPVAVPNTEKDGDNSKPIVARDRWVGKVNFVEIRSFWHVFRSFDRMWSFYILCLQAMIIMAWDGGQPSSVFGADVFKKVLSVFITAAIMKLGQAVLDVILNFKAHQSMTLHVKLRYILKVFSAAAWVIILPVTYAYSWKDPPAFARTIKSWFGSAMHSPSLFIIAVVSYLSPNMLAETNENLLLCCLTDVTIINTLQPRLYVGRGMHESAFSLFKYTMFWVLLIATKLAFSYYIEIRPLVAPTQAIMKARVTNFQWHEFFPRAKNNIGVVIALWAPIILVYFMDSQIWYAIFSTLFGGIYGAFRRLGEIRTLGMLRSRFESLPGAFNDRLIPDGKNQQKKKGIRATLSHNFTEDKVPVNKEKEAARFAQLWNTIISSFREEDLISDREMDLLLVPYWADRDLDLIQWPPFLLASKIPIALDMAKDSNGKDRELKKRIESDTYMKCAVRECYASFKNIIKFVVQGNREKEVIEIIFAEVDKHIDTGDLIQEYKMSALPSLYDHFVKLIKYLLDNKEEDRDHVVILFQDMLEVVTRDIMMEDYNISSLVDSSHGGTWHGGMIPLEQQYQLFASSGAIRFPIEPVTEAWKEKIKRIYLLLTTKESAMDVPSNLEARRRISFFSNSLFMDMPMAPKVRNMLSFSVLTPYYTEEVLFSLRDLETPNEDGVSILFYLQKIFPDEWNNFLERVKCLSEEELKESDELEEELRLWASYRGQTLTRTVRGMMYYRKALELQAFLDMAMHEDLMEGYKAVELNSENNSRGERSLWAQCQAVADMKFTYVVSCQQYGIHKRSGDPRAQDILRLMTRYPSLRVAYIDEVEEPVKDKSKKGNQKVYYSVLVKVPKSTDHSTLAQNLDQVIYRIRLPGPAILGEGKPENQNHAIIFSRGEGLQTIDMNQDNYMEEALKMRNLLQEFLTKHDGVRHPSILGLREHIFTGSVSSLAWFMSNQETSFVTIGQRLLANPLRVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMMSCYFTTVGFYFSTLITVLTVYIFLYGRLYLVLSGLEQGLSTQKGIRDNTPLQIALASQSFVQIGFLMALPMLMEIGLERGFRTALSEFVLMQLQLAPVFFTFSLGTKTHYYGRTLLHGGAKYRSTGRGFVVFHAKFADNYRLYSRSHFVKGLEMMLLLVVYQIFGSAYRGVLAYLLITISMWFMVGTWLFAPFLFNPSGFEWQKIVDDWTDWNKWINNIGGIGVPAEKSWESWWEEEQEHLRYSGKRGIVVEILLALRFFIYQYGLVYHLTITEKTKNFLVYGVSWLVIFLILFVMKTVSVGRRRFSASFQLMFRLIKGLIFMTFIAIIVILITLAHMTIQDIIVCILAFMPTGWGMLLIAQACKPVVHRAGFWGSVRTLARGYEIVMGLLLFTPVAFLAWFPFVSEFQTRMLFNQAFSRGLQISRILGGHRKDRSSRNKE

SEQ ID NO: 50 - protein, 1947 aa, Artificial Sequence
  CALS3 with R1926K substitution
MSATRGGPDQGPSQPQQRRIIRTQTAGNLGESFDSEVVPSSLVEIAPILRVANEVESSNPRVAYLCRFYAFEKAHRLDPTSSGRGVRQFKTALLQRLEREHDPTLMGRVKKSDAREMQSFYQHYYKKYIQALHNAADKADRAQLTKAYQTANVLFEVLKAVNLTQSIEVDREILEAQDKVAEKTQLYVPYNILPLDPDSANQAIMRYPEIQAAVLALRNTRGLPWPEGHKKKKDEDMLDWLQEMFGFQKDNVANQREHLILLLANVHIRQFPKPDQQPKLDDQALTEVMKKLFKNYKKWCKYLGRKSSLWLPTIQQEMQQRKLLYMALYLLIWGEAANLRFMPECLCYIYHHMAFELYGMLAGNVSPMTGENVKPAYGGEEDAFLRKVVTPIYEVIQMEAQRSKKGKSKHSQWRNYDDLNEYFWSVDCFRLGWPMRADADFFCLPVAVPNTEKDGDNSKPIVARDRWVGKVNFVEIRSFWHVFRSFDRMWSFYILCLQAMIIMAWDGGQPSSVFGADVFKKVLSVFITAAIMKLGQAVLDVILNFKAHQSMTLHVKLRYILKVFSAAAWVIILPVTYAYSWKDPPAFARTIKSWFGSAMHSPSLFIIAVVSYLSPNMLAETNENLLLCCLTDVTIINTLQPRLYVGRGMHESAFSLFKYTMFWVLLIATKLAFSYYIEIRPLVAPTQAIMKARVTNFQWHEFFPRAKNNIGVVIALWAPIILVYFMDSQIWYAIFSTLFGGIYGAFRRLGEIRTLGMLRSRFESLPGAFNDRLIPDGKNQQKKKGIRATLSHNFTEDKVPVNKEKEAARFAQLWNTIISSFREEDLISDREMDLLLVPYWADRDLDLIQWPPFLLASKIPIALDMAKDSNGKDRELKKRIESDTYMKCAVRECYASFKNIIKFVVQGNREKEVIEIIFAEVDKHIDTGDLIQEYKMSALPSLYDHFVKLIKYLLDNKEEDRDHVVILFQDMLEVVTRDIMMEDYNISSLVDSSHGGTWHGGMIPLEQQYQLFASSGAIRFPIEPVTEAWKEKIKRIYLLLTTKESAMDVPSNLEARRRISFFSNSLFMDMPMAPKVRNMLSFSVLTPYYTEEVLFSLRDLETPNEDGVSILFYLQKIFPDEWNNFLERVKCLSEEELKESDELEEELRLWASYRGQTLTRTVRGMMYYRKALELQAFLDMAMHEDLMEGYKAVELNSENNSRGERSLWAQCQAVADMKFTYVVSCQQYGIHKRSGDPRAQDILRLMTRYPSLRVAYIDEVEEPVKDKSKKGNQKVYYSVLVKVPKSTDHSTLAQNLDQVIYRIRLPGPAILGEGKPENQNHAIIFSRGEGLQTIDMNQDNYMEEALKMRNLLQEFLTKHDGVRHPSILGLREHIFTGSVSSLAWFMSNQETSFVTIGQRLLANPLRVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMMSCYFTTVGFYFSTLITVLTVYIFLYGRLYLVLSGLEQGLSTQKGIRDNTPLQIALASQSFVQIGFLMALPMLMEIGLERGFRTALSEFVLMQLQLAPVFFTFSLGTKTHYYGRTLLHGGAKYRSTGRGFVVFHAKFADNYRLYSRSHFVKGLEMMLLLVVYQIFGSAYRGVLAYLLITISMWFMVGTWLFAPFLFNPSGFEWQKIVDDWTDWNKWINNIGGIGVPAEKSWESWWEEEQEHLRYSGKRGIVVEILLALRFFIYQYGLVYHLTITEKTKNFLVYGVSWLVIFLILFVMKTVSVGRRRFSASFQLMFRLIKGLIFMTFIAIIVILITLAHMTIQDIIVCILAFMPTGWGMLLIAQACKPVVHRAGFWGSVRTLARGYEIVMGLLLFTPVAFLAWFPFVSEFQTRMLFNQAFSKGLQISRILGGHRKDRSSRNKE

SEQ ID NO: 51 - protein, 1947 aa, Artificial Sequence
  CALS3 with P189L substitution
MSATRGGPDQGPSQPQQRRIIRTQTAGNLGESFDSEVVPSSLVEIAPILRVANEVESSNPRVAYLCRFYAFEKAHRLDPTSSGRGVRQFKTALLQRLEREHDPTLMGRVKKSDAREMQSFYQHYYKKYIQALHNAADKADRAQLTKAYQTANVLFEVLKAVNLTQSIEVDREILEAQDKVAEKTQLYVLYNILPLDPDSANQAIMRYPEIQAAVLALRNTRGLPWPEGHKKKKDEDMLDWLQEMFGFQKDNVANQREHLILLLANVHIRQFPKPDQQPKLDDQALTEVMKKLFKNYKKWCKYLGRKSSLWLPTIQQEMQQRKLLYMALYLLIWGEAANLRFMPECLCYIYHHMAFELYGMLAGNVSPMTGENVKPAYGGEEDAFLRKVVTPIYEVIQMEAQRSKKGKSKHSQWRNYDDLNEYFWSVDCFRLGWPMRADADFFCLPVAVPNTEKDGDNSKPIVARDRWVGKVNFVEIRSFWHVFRSFDRMWSFYILCLQAMIIMAWDGGQPSSVFGADVFKKVLSVFITAAIMKLGQAVLDVILNFKAHQSMTLHVKLRYILKVFSAAAWVIILPVTYAYSWKDPPAFARTIKSWFGSAMHSPSLFIIAVVSYLSPNMLAETNENLLLCCLTDVTIINTLQPRLYVGRGMHESAFSLFKYTMFWVLLIATKLAFSYYIEIRPLVAPTQAIMKARVTNFQWHEFFPRAKNNIGVVIALWAPIILVYFMDSQIWYAIFSTLFGGIYGAFRRLGEIRTLGMLRSRFESLPGAFNDRLIPDGKNQQKKKGIRATLSHNFTEDKVPVNKEKEAARFAQLWNTIISSFREEDLISDREMDLLLVPYWADRDLDLIQWPPFLLASKIPIALDMAKDSNGKDRELKKRIESDTYMKCAVRECYASFKNIIKFVVQGNREKEVIEIIFAEVDKHIDTGDLIQEYKMSALPSLYDHFVKLIKYLLDNKEEDRDHVVILFQDMLEVVTRDIMMEDYNISSLVDSSHGGTWHGGMIPLEQQYQLFASSGAIRFPIEPVTEAWKEKIKRIYLLLTTKESAMDVPSNLEARRRISFFSNSLFMDMPMAPKVRNMLSFSVLTPYYTEEVLFSLRDLETPNEDGVSILFYLQKIFPDEWNNFLERVKCLSEEELKESDELEEELRLWASYRGQTLTRTVRGMMYYRKALELQAFLDMAMHEDLMEGYKAVELNSENNSRGERSLWAQCQAVADMKFTYVVSCQQYGIHKRSGDPRAQDILRLMTRYPSLRVAYIDEVEEPVKDKSKKGNQKVYYSVLVKVPKSTDHSTLAQNLDQVIYRIRLPGPAILGEGKPENQNHAIIFSRGEGLQTIDMNQDNYMEEALKMRNLLQEFLTKHDGVRHPSILGLREHIFTGSVSSLAWFMSNQETSFVTIGQRLLANPLRVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMMSCYFTTVGFYFSTLITVLTVYIFLYGRLYLVLSGLEQGLSTQKGIRDNTPLQIALASQSFVQIGFLMALPMLMEIGLERGFRTALSEFVLMQLQLAPVFFTFSLGTKTHYYGRTLLHGGAKYRSTGRGFVVFHAKFADNYRLYSRSHFVKGLEMMLLLVVYQIFGSAYRGVLAYLLITISMWFMVGTWLFAPFLFNPSGFEWQKIVDDWTDWNKWINNIGGIGVPAEKSWESWWEEEQEHLRYSGKRGIVVEILLALRFFIYQYGLVYHLTITEKTKNFLVYGVSWLVIFLILFVMKTVSVGRRRFSASFQLMFRLIKGLIFMTFIAIIVILITLAHMTIQDIIVCILAFMPTGWGMLLIAQACKPVVHRAGFWGSVRTLARGYEIVMGLLLFTPVAFLAWFPFVSEFQTRMLFNQAFSRGLQISRILGGHRKDRSSRNKE

SEQ ID NO: 52 - protein, 1947 aa, Artificial Sequence
  CALS3 with R84K and R1926K substitutions
MSATRGGPDQGPSQPQQRRIIRTQTAGNLGESFDSEVVPSSLVEIAPILRVANEVESSNPRVAYLCRFYAFEKAHRLDPTSSGKGVRQFKTALLQRLEREHDPTLMGRVKKSDAREMQSFYQHYYKKYIQALHNAADKADRAQLTKAYQTANVLFEVLKAVNLTQSIEVDREILEAQDKVAEKTQLYVPYNILPLDPDSANQAIMRYPEIQAAVLALRNTRGLPWPEGHKKKKDEDMLDWLQEMFGFQKDNVANQREHLILLLANVHIRQFPKPDQQPKLDDQALTEVMKKLFKNYKKWCKYLGRKSSLWLPTIQQEMQQRKLLYMALYLLIWGEAANLRFMPECLCYIYHHMAFELYGMLAGNVSPMTGENVKPAYGGEEDAFLRKVVTPIYEVIQMEAQRSKKGKSKHSQWRNYDDLNEYFWSVDCFRLGWPMRADADFFCLPVAVPNTEKDGDNSKPIVARDRWVGKVNFVEIRSFWHVFRSFDRMWSFYILCLQAMIIMAWDGGQPSSVFGADVFKKVLSVFITAAIMKLGQAVLDVILNFKAHQSMTLHVKLRYILKVFSAAAWVIILPVTYAYSWKDPPAFARTIKSWFGSAMHSPSLFIIAVVSYLSPNMLAETNENLLLCCLTDVTIINTLQPRLYVGRGMHESAFSLFKYTMFWVLLIATKLAFSYYIEIRPLVAPTQAIMKARVTNFQWHEFFPRAKNNIGVVIALWAPIILVYFMDSQIWYAIFSTLFGGIYGAFRRLGEIRTLGMLRSRFESLPGAFNDRLIPDGKNQQKKKGIRATLSHNFTEDKVPVNKEKEAARFAQLWNTIISSFREEDLISDREMDLLLVPYWADRDLDLIQWPPFLLASKIPIALDMAKDSNGKDRELKKRIESDTYMKCAVRECYASFKNIIKFVVQGNREKEVIEIIFAEVDKHIDTGDLIQEYKMSALPSLYDHFVKLIKYLLDNKEEDRDHVVILFQDMLEVVTRDIMMEDYNISSLVDSSHGGTWHGGMIPLEQQYQLFASSGAIRFPIEPVTEAWKEKIKRIYLLLTTKESAMDVPSNLEARRRISFFSNSLFMDMPMAPKVRNMLSFSVLTPYYTEEVLFSLRDLETPNEDGVSILFYLQKIFPDEWNNFLERVKCLSEEELKESDELEEELRLWASYRGQTLTRTVRGMMYYRKALELQAFLDMAMHEDLMEGYKAVELNSENNSRGERSLWAQCQAVADMKFTYVVSCQQYGIHKRSGDPRAQDILRLMTRYPSLRVAYIDEVEEPVKDKSKKGNQKVYYSVLVKVPKSTDHSTLAQNLDQVIYRIRLPGPAILGEGKPENQNHAIIFSRGEGLQTIDMNQDNYMEEALKMRNLLQEFLTKHDGVRHPSILGLREHIFTGSVSSLAWFMSNQETSFVTIGQRLLANPLRVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMMSCYFTTVGFYFSTLITVLTVYIFLYGRLYLVLSGLEQGLSTQKGIRDNTPLQIALASQSFVQIGFLMALPMLMEIGLERGFRTALSEFVLMQLQLAPVFFTFSLGTKTHYYGRTLLHGGAKYRSTGRGFVVFHAKFADNYRLYSRSHFVKGLEMMLLLVVYQIFGSAYRGVLAYLLITISMWFMVGTWLFAPFLFNPSGFEWQKIVDDWTDWNKWINNIGGIGVPAEKSWESWWEEEQEHLRYSGKRGIVVEILLALRFFIYQYGLVYHLTITEKTKNFLVYGVSWLVIFLILFVMKTVSVGRRRFSASFQLMFRLIKGLIFMTFIAIIVILITLAHMTIQDIIVCILAFMPTGWGMLLIAQACKPVVHRAGFWGSVRTLARGYEIVMGLLLFTPVAFLAWFPFVSEFQTRMLFNQAFSKGLQISRILGGHRKDRSSRNKE

SEQ ID NO: 53 - protein, 1947 aa, Artificial Sequence
  CALS3 with R84K and P189L substitutions
MSATRGGPDQGPSQPQQRRIIRTQTAGNLGESFDSEVVPSSLVEIAPILRVANEVESSNPRVAYLCRFYAFEKAHRLDPTSSGKGVRQFKTALLQRLEREHDPTLMGRVKKSDAREMQSFYQHYYKKYIQALHNAADKADRAQLTKAYQTANVLFEVLKAVNLTQSIEVDREILEAQDKVAEKTQLYVLYNILPLDPDSANQAIMRYPEIQAAVLALRNTRGLPWPEGHKKKKDEDMLDWLQEMFGFQKDNVANQREHLILLLANVHIRQFPKPDQQPKLDDQALTEVMKKLFKNYKKWCKYLGRKSSLWLPTIQQEMQQRKLLYMALYLLIWGEAANLRFMPECLCYIYHHMAFELYGMLAGNVSPMTGENVKPAYGGEEDAFLRKVVTPIYEVIQMEAQRSKKGKSKHSQWRNYDDLNEYFWSVDCFRLGWPMRADADFFCLPVAVPNTEKDGDNSKPIVARDRWVGKVNFVEIRSFWHVFRSFDRMWSFYILCLQAMIIMAWDGGQPSSVFGADVFKKVLSVFITAAIMKLGQAVLDVILNFKAHQSMTLHVKLRYILKVFSAAAWVIILPVTYAYSWKDPPAFARTIKSWFGSAMHSPSLFIIAVVSYLSPNMLAETNENLLLCCLTDVTIINTLQPRLYVGRGMHESAFSLFKYTMFWVLLIATKLAFSYYIEIRPLVAPTQAIMKARVTNFQWHEFFPRAKNNIGVVIALWAPIILVYFMDSQIWYAIFSTLFGGIYGAFRRLGEIRTLGMLRSRFESLPGAFNDRLIPDGKNQQKKKGIRATLSHNFTEDKVPVNKEKEAARFAQLWNTIISSFREEDLISDREMDLLLVPYWADRDLDLIQWPPFLLASKIPIALDMAKDSNGKDRELKKRIESDTYMKCAVRECYASFKNIIKFVVQGNREKEVIEIIFAEVDKHIDTGDLIQEYKMSALPSLYDHFVKLIKYLLDNKEEDRDHVVILFQDMLEVVTRDIMMEDYNISSLVDSSHGGTWHGGMIPLEQQYQLFASSGAIRFPIEPVTEAWKEKIKRIYLLLTTKESAMDVPSNLEARRRISFFSNSLFMDMPMAPKVRNMLSFSVLTPYYTEEVLFSLRDLETPNEDGVSILFYLQKIFPDEWNNFLERVKCLSEEELKESDELEEELRLWASYRGQTLTRTVRGMMYYRKALELQAFLDMAMHEDLMEGYKAVELNSENNSRGERSLWAQCQAVADMKFTYVVSCQQYGIHKRSGDPRAQDILRLMTRYPSLRVAYIDEVEEPVKDKSKKGNQKVYYSVLVKVPKSTDHSTLAQNLDQVIYRIRLPGPAILGEGKPENQNHAIIFSRGEGLQTIDMNQDNYMEEALKMRNLLQEFLTKHDGVRHPSILGLREHIFTGSVSSLAWFMSNQETSFVTIGQRLLANPLRVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMMSCYFTTVGFYFSTLITVLTVYIFLYGRLYLVLSGLEQGLSTQKGIRDNTPLQIALASQSFVQIGFLMALPMLMEIGLERGFRTALSEFVLMQLQLAPVFFTFSLGTKTHYYGRTLLHGGAKYRSTGRGFVVFHAKFADNYRLYSRSHFVKGLEMMLLLVVYQIFGSAYRGVLAYLLITISMWFMVGTWLFAPFLFNPSGFEWQKIVDDWTDWNKWINNIGGIGVPAEKSWESWWEEEQEHLRYSGKRGIVVEILLALRFFIYQYGLVYHLTITEKTKNFLVYGVSWLVIFLILFVMKTVSVGRRRFSASFQLMFRLIKGLIFMTFIAIIVILITLAHMTIQDIIVCILAFMPTGWGMLLIAQACKPVVHRAGFWGSVRTLARGYEIVMGLLLFTPVAFLAWFPFVSEFQTRMLFNQAFSRGLQISRILGGHRKDRSSRNKE

SEQ ID NO: 54 - protein, 1947 aa, Artificial Sequence
  CALS3 with R1926K and P189L substitutions
MSATRGGPDQGPSQPQQRRIIRTQTAGNLGESFDSEVVPSSLVEIAPILRVANEVESSNPRVAYLCRFYAFEKAHRLDPTSSGRGVRQFKTALLQRLEREHDPTLMGRVKKSDAREMQSFYQHYYKKYIQALHNAADKADRAQLTKAYQTANVLFEVLKAVNLTQSIEVDREILEAQDKVAEKTQLYVLYNILPLDPDSANQAIMRYPEIQAAVLALRNTRGLPWPEGHKKKKDEDMLDWLQEMFGFQKDNVANQREHLILLLANVHIRQFPKPDQQPKLDDQALTEVMKKLFKNYKKWCKYLGRKSSLWLPTIQQEMQQRKLLYMALYLLIWGEAANLRFMPECLCYIYHHMAFELYGMLAGNVSPMTGENVKPAYGGEEDAFLRKVVTPIYEVIQMEAQRSKKGKSKHSQWRNYDDLNEYFWSVDCFRLGWPMRADADFFCLPVAVPNTEKDGDNSKPIVARDRWVGKVNFVEIRSFWHVFRSFDRMWSFYILCLQAMIIMAWDGGQPSSVFGADVFKKVLSVFITAAIMKLGQAVLDVILNFKAHQSMTLHVKLRYILKVFSAAAWVIILPVTYAYSWKDPPAFARTIKSWFGSAMHSPSLFIIAVVSYLSPNMLAETNENLLLCCLTDVTIINTLQPRLYVGRGMHESAFSLFKYTMFWVLLIATKLAFSYYIEIRPLVAPTQAIMKARVTNFQWHEFFPRAKNNIGVVIALWAPIILVYFMDSQIWYAIFSTLFGGIYGAFRRLGEIRTLGMLRSRFESLPGAFNDRLIPDGKNQQKKKGIRATLSHNFTEDKVPVNKEKEAARFAQLWNTIISSFREEDLISDREMDLLLVPYWADRDLDLIQWPPFLLASKIPIALDMAKDSNGKDRELKKRIESDTYMKCAVRECYASFKNIIKFVVQGNREKEVIEIIFAEVDKHIDTGDLIQEYKMSALPSLYDHFVKLIKYLLDNKEEDRDHVVILFQDMLEVVTRDIMMEDYNISSLVDSSHGGTWHGGMIPLEQQYQLFASSGAIRFPIEPVTEAWKEKIKRIYLLLTTKESAMDVPSNLEARRRISFFSNSLFMDMPMAPKVRNMLSFSVLTPYYTEEVLFSLRDLETPNEDGVSILFYLQKIFPDEWNNFLERVKCLSEEELKESDELEEELRLWASYRGQTLTRTVRGMMYYRKALELQAFLDMAMHEDLMEGYKAVELNSENNSRGERSLWAQCQAVADMKFTYVVSCQQYGIHKRSGDPRAQDILRLMTRYPSLRVAYIDEVEEPVKDKSKKGNQKVYYSVLVKVPKSTDHSTLAQNLDQVIYRIRLPGPAILGEGKPENQNHAIIFSRGEGLQTIDMNQDNYMEEALKMRNLLQEFLTKHDGVRHPSILGLREHIFTGSVSSLAWFMSNQETSFVTIGQRLLANPLRVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMMSCYFTTVGFYFSTLITVLTVYIFLYGRLYLVLSGLEQGLSTQKGIRDNTPLQIALASQSFVQIGFLMALPMLMEIGLERGFRTALSEFVLMQLQLAPVFFTFSLGTKTHYYGRTLLHGGAKYRSTGRGFVVFHAKFADNYRLYSRSHFVKGLEMMLLLVVYQIFGSAYRGVLAYLLITISMWFMVGTWLFAPFLFNPSGFEWQKIVDDWTDWNKWINNIGGIGVPAEKSWESWWEEEQEHLRYSGKRGIVVEILLALRFFIYQYGLVYHLTITEKTKNFLVYGVSWLVIFLILFVMKTVSVGRRRFSASFQLMFRLIKGLIFMTFIAIIVILITLAHMTIQDIIVCILAFMPTGWGMLLIAQACKPVVHRAGFWGSVRTLARGYEIVMGLLLFTPVAFLAWFPFVSEFQTRMLFNQAFSKGLQISRILGGHRKDRSSRNKE

SEQ ID NO: 55 - protein, 1947 aa, Artificial Sequence
  CALS3 with R84K, R1926K and P189L substitutions
MSATRGGPDQGPSQPQQRRIIRTQTAGNLGESFDSEVVPSSLVEIAPILRVANEVESSNPRVAYLCRFYAFEKAHRLDPTSSGKGVRQFKTALLQRLEREHDPTLMGRVKKSDAREMQSFYQHYYKKYIQALHNAADKADRAQLTKAYQTANVLFEVLKAVNLTQSIEVDREILEAQDKVAEKTQLYVLYNILPLDPDSANQAIMRYPEIQAAVLALRNTRGLPWPEGHKKKKDEDMLDWLQEMFGFQKDNVANQREHLILLLANVHIRQFPKPDQQPKLDDQALTEVMKKLFKNYKKWCKYLGRKSSLWLPTIQQEMQQRKLLYMALYLLIWGEAANLRFMPECLCYIYHHMAFELYGMLAGNVSPMTGENVKPAYGGEEDAFLRKVVTPIYEVIQMEAQRSKKGKSKHSQWRNYDDLNEYFWSVDCFRLGWPMRADADFFCLPVAVPNTEKDGDNSKPIVARDRWVGKVNFVEIRSFWHVFRSFDRMWSFYILCLQAMIIMAWDGGQPSSVFGADVFKKVLSVFITAAIMKLGQAVLDVILNFKAHQSMTLHVKLRYILKVFSAAAWVIILPVTYAYSWKDPPAFARTIKSWFGSAMHSPSLFIIAVVSYLSPNMLAETNENLLLCCLTDVTIINTLQPRLYVGRGMHESAFSLFKYTMFWVLLIATKLAFSYYIEIRPLVAPTQAIMKARVTNFQWHEFFPRAKNNIGVVIALWAPIILVYFMDSQIWYAIFSTLFGGIYGAFRRLGEIRTLGMLRSRFESLPGAFNDRLIPDGKNQQKKKGIRATLSHNFTEDKVPVNKEKEAARFAQLWNTIISSFREEDLISDREMDLLLVPYWADRDLDLIQWPPFLLASKIPIALDMAKDSNGKDRELKKRIESDTYMKCAVRECYASFKNIIKFVVQGNREKEVIEIIFAEVDKHIDTGDLIQEYKMSALPSLYDHFVKLIKYLLDNKEEDRDHVVILFQDMLEVVTRDIMMEDYNISSLVDSSHGGTWHGGMIPLEQQYQLFASSGAIRFPIEPVTEAWKEKIKRIYLLLTTKESAMDVPSNLEARRRISFFSNSLFMDMPMAPKVRNMLSFSVLTPYYTEEVLFSLRDLETPNEDGVSILFYLQKIFPDEWNNFLERVKCLSEEELKESDELEEELRLWASYRGQTLTRTVRGMMYYRKALELQAFLDMAMHEDLMEGYKAVELNSENNSRGERSLWAQCQAVADMKFTYVVSCQQYGIHKRSGDPRAQDILRLMTRYPSLRVAYIDEVEEPVKDKSKKGNQKVYYSVLVKVPKSTDHSTLAQNLDQVIYRIRLPGPAILGEGKPENQNHAIIFSRGEGLQTIDMNQDNYMEEALKMRNLLQEFLTKHDGVRHPSILGLREHIFTGSVSSLAWFMSNQETSFVTIGQRLLANPLRVRFHYGHPDVFDRLFHLTRGGVSKASKVINLSEDIFAGFNSTLREGNVTHHEYIQVGKGRDVGLNQISMFEAKIANGNGEQTLSRDIYRLGHRFDFFRMMSCYFTTVGFYFSTLITVLTVYIFLYGRLYLVLSGLEQGLSTQKGIRDNTPLQIALASQSFVQIGFLMALPMLMEIGLERGFRTALSEFVLMQLQLAPVFFTFSLGTKTHYYGRTLLHGGAKYRSTGRGFVVFHAKFADNYRLYSRSHFVKGLEMMLLLVVYQIFGSAYRGVLAYLLITISMWFMVGTWLFAPFLFNPSGFEWQKIVDDWTDWNKWINNIGGIGVPAEKSWESWWEEEQEHLRYSGKRGIVVEILLALRFFIYQYGLVYHLTITEKTKNFLVYGVSWLVIFLILFVMKTVSVGRRRFSASFQLMFRLIKGLIFMTFIAIIVILITLAHMTIQDIIVCILAFMPTGWGMLLIAQACKPVVHRAGFWGSVRTLARGYEIVMGLLLFTPVAFLAWFPFVSEFQTRMLFNQAFSKGLQISRILGGHRKDRSSRNKE

SEQ ID NO: 56 - DNA, 10758 bp, Arabidopsis thaliana
  At5g13000 gDNA WT
atgtctgctacgagaggaggtcctgatcaagggccgtctcagcctcagcagcggcggattatacgaactcagactgctggtaatcttggagagtcattcgatagtgaagttgttccatcatctcttgttgagattgcccccattcttcgggttgctaatgaagttgaatctagtaatcctagggttgcgtatctctgtaagttcttctaaaacttatttcttaatttggttctctgtcatttggttgtttatctggtttttggttctgctttctcccttaggtcggttttatgcatttgagaaagcacatagattggatcctacctccagtggaagaggtgttcggcagtttaagactgcacttctacagcgtcttgaaagagtgagcattctttatactctgcttgattcttgcatgtggcagatttggatagctattagaaggaatcttggttttagtacttttctttgacaaatgtggtctactgttgctttgatttttttgcaggaacatgatccaacactgatgggcagggttaagaaaagtgatgcccgtgaaatgcaaagcttttatcaacactactataagaagtatattcaagctttgcacaatgctgctgataaggctgaccggtatgtctaacttacttaaattgtctttttaagatgctaatttgtgttttgccagtgtttgagagcactaaattctcttaatgatactttgaagtgctgttaattttcagtgcccagctgacaaaggcataccaaactgccaatgttttgtttgaggtgttgaaggctgttaatctgacacagtccattgaggttgaccgggaggtaaggcattgtgaccttctagtcctgtctcttttttttttccatctcttgtgcaactttacaatgaagttgaatggttccagattctggaagctcaagataaggttgcagaaaagacacagttgtatgtcccctataatatcctacctctcgatcctgatagtgccaatcaagcgattatgagatatcctgaggttagtcctcttcttgttgggcattgttattatttgtaatatgttatcagcgggtgatgtaatccttactgcagatccaagctgctgttcttgctctccgcaatactagaggtcttccttggccagaaggtcacaagaaaaagaaagatgaagacatgcttgattggcttcaagaaatgtttggatttcaggtaatttttctagttcgtgatgcttgccaattgtcattaagcttttgttgagagtaatctataaattctttaatggtttggcggaaagacaatgcagctaatcttaggagcacttaatcttattacttgctaacatgcaatttttcttgtttatgctatggttctgcagaaagacaatgtggctaatcaaagggagcatctgatcttattacttgctaatgtgcatataagacaatttcctaagcctgatcagcagccaaaggtttataccttaattttaccattgttgaaagaccacttttatataggtttcgtgtgtccatgcatgtaggacatttctgcgcagtacattttttttccatggaatatatatgtaactgcatcctactatgagcataatatttaatgaatgtactttcagtttatcctttcgtttgttctcattgtgccctcacagttagatgatcaagcattgacagaagtgatgaagaagcttttcaagaactataagaaatggtgcaaataccttggtcgaaagagtagtctttggtaagggaattgtagcaacagagagtttctgtatgctgttcatgtacaggaattagatttcgtgtgtgtgtctaaatgtttatgcaaactctggtgtggagaatctgttttaaagtatgatcttcttgtaggttgccaactatacagcaggaaatgcagcagcgcaaactattgtatatggccctgtatcttctaatttggggtgaagcagcgaacttgagattcatgccagagtgtctctgctacatttatcatcatgtaagtttcagtttgtaaggtcttccgtagtttgtgcgtgattcttgtatttttatgcttgtccgccaatgataatcttatgctttactgtcattcttaatccttgaaagttatatcttttgttgtttatatttctgctaaggagctataacttgcacgcacagtaataaaattgtcatctgagtcttgttttgaggcaaaacatgtgtatatgtgctcaggttgacgtatttctgatgagaaaatgtcaattgatattattccccttagaaattagaatgttggttaaatgtcaattgtgctcagggtaccatgctttcttttgataaatacacagattttttgctagtatgcgttcctagatgtgatattcttatacttcctactctatttcatgctttcgcagatggcatttgaactctatggtatgctggctgggaatgttagtcctatgactggggaaaatgtgaagccagcttatggaggcgaggaagatgcattcttgaggaaagttgtgactcctatttatgaagtgattcagatggtaggccttaaatttcgagcttttccttgtgctttcagcagttttttgcttgttaatattcttactcactaattgtgccattcacaggaggctcaaagaagcaaaaaagggaagtctaagcactctcagtggaggaactacgatgatttgaatgaatacttttggtgatatatctatctacctgctttcacacagtcgtaaaggtcttcataagtggtttctacgattaatcaagtatggtttcttcattgcaggtcagttgattgttttcggttaggttggccaatgcgagctgatgctgatttcttttgtctgcctgttgctgtacccaatacagaaaaggacggggtacactataactacacatcttctctgttcttgtctatatattttttttgggtttcgggaatctgctacactgctctagtttctaggtggtgtggttttttttatactaggaactctaatcttttgctactgaattttttttatcatatatcacaggataacagcaagcctattgtcgccagagatagatgggttggtaaagttaattttgttgagattcgttctttctggcatgtcttcagaagtttcgatcgaatgtggagcttctatattctgtgcctccaggtattactatcttctatatgtctctgcctctctctggagctgatgtattaaagaaatgcacattctcataaaatatgatttcgatgatgaattttggaaggccatgattattatggcctgggatggcggacaaccaagttcagtctttggagctgatgtattcaagaaagttctgagcgtgtttatcacagctgcaataatgaaacttggacaaggttggttaatgtaattgttcaatactttcataagtttacttgagtgacgaaagctcatctactagaactatttctgcagctgttcttgatgtgatccttaatttcaaagctcatcaaagcatgacactacatgttaaactaagatacattctgaaagtgttctctgctgctgcctgggttattattctgcctgttacttacgcctacagctggaaagatcctccagcatttgccagaactatcaagagttggtttgggagtgctatgcactcaccttctctatttataatagcagtcgtttcctatttgtcacctaacatgctcgcgggtgtaatgtttcttttccctctgctacgacggtttcttgagaggtccaactacagaattgtaatgctaatgatgtggtggtctcaggttttcatctattcactcagtttgtgttcttgcataagaaactaacgaaaaccttctgttgtgttgtttaactgatgtgactataattaacaccttgcagcccagactctacgttggcagaggaatgcacgagagcgcattttccctcttcaagtaagggttctgtttgtgacataaacatcattggattttagttactggtgcaagcctgagtcctctgttcactcatgtctctctacctttttcttgcgtagatataccatgttctgggtgttgcttattgcaacaaagctggcattcagttactacattgaggtatgtgtttcttgtatctagttctggtaattattaaccatgctgtgagaagagtaagattcgtgatgagacatggaaacaataattatgggattgaattgactgatttttccatgattgccacaactgaagtctgataaattggcattgctcacagatcaggcctttagttgccccaacacaagccattatgaaggcccgtgtgacaaattttcagtggcatgagttctttcctcgtggtaatgcactttcacatacactacatgattgctggaatgaaaatttatcatttattctcacaccatctctacttgatttgtgcagccaaaaacaatattggtgtcgttatcgccctctgggcccccattattctggtaagcatggtcaagtcgaacatgtctgcacgtcctcccctgctttgtgctgttgctaatttgatctcggctacatcttgctgcaggtatattttatggatagtcagatttggtatgctatattttccacattatttggaggtatctacggtgcattccgccgccttggagaggtatgcatttttaagataatctgattgaagctgagttatttgttgaacttgaggtttcccttgtaattgttattgatgttctctaaatccttgcgtttttcacttgttacagattcggacactgggaatgctcagatcacggtttgaatcactgcctggagcttttaatgaccgcttaattccagatggaaagaaccagcaaaagaagaagggaataagggcaacgttatctcataactttacggaggataaggtttgttgaacgagtgaactgctatcacgtacaattcttctcattgattgcttgtactgaaaatttacttcaggtacctgtgaacaaagagaaagaagctgcaagatttgcacagttgtggaacacaataattagtagttttagagaggaagatcttataagtgataggtaattttattaattttctatgccacatatctagctgaaagaaactatctggaactcaaaaaatttgagctatctttttgcatttggactattcatagggagatggatctgttgcttgttccttattgggctgaccgtgatttggatctcatacagtggcctcccttcttattggctagcaaggtttgctctcacagaaacacattagaatttaatcttttggttattctaattttttctatatttggctgtagattccaatagcattagatatggcaaaagacagtaatgggaaggacagagagctcaagaagaggattgagagtgacacttacatgaaatgtgctgtccgtgaatgctatgcttcattcaagaatatcataaaatttgtggttcagggaaaccgtgaaaaagagtaagttgggttaagtttttggaaccatagtgtttgaacttgcttttgtttcttacatatctacttctgattttgataattgcaagtttgcaacgtaccacactatattatggccaatttatatcttcgtgtctcagggtgatagagatcatatttgcagaggttgacaaacatatagatacaggggatttgattcaagaatacaagatgagtgctcttcctagcctctatgatcactttgtcaagttgatcaaatatttggtaaatgttcttcctgtggtactgtttcttttgtagttttagtatctaaaaacttatttgtcaattggtccaatatcttcgttttcttatccaatgtagcttgacaataaggaggaagatagagatcacgttgtaattctcttccaagacatgctggaagttgtaacaagagacattatgatggaggattacaatatatcgaggttggcgactttctaccgcaccgcaatggcttgtcgtatgaacatcaaaatcttatatatctagtgtctctgtagcttggtagattcaagtcatggtggcacttggcatgggggaatgatccctctcgaacaacaatatcagctgtttgcatcctcaggtgccattagatttcctattgaaccagtaacagaagcttggaaagagaaggttatgccagatagggttatatttaagttctattcgcgcagtcttcatatgatttgttctcaaaactttaatgcatgtatgtgtagatcaaacggatatatcttttgttgactactaaagagtctgctatggatgtcccctctaacttggaagcaagaaggcggatctcattcttctcaaattcgttgttcatggacatgcctatggcacctaaagttcgcaacatgctatcattttcgtaagcaatttctggtcattttaattagaatccactacttatatagtcacatattgttggaagattattggttcttctaaaattccagttgataatttcctcaaattcttcttttatgatgacaaaactaagatttagaactgttgtatcatgcaattgctacttgtttataattataatgaagtatgaattgcaatgtagtttttcgtaactgaactggctgggttagtttgtcattataatgttttgcttttattgaagttttcgttacttaactggtggggttttctctttgctattctcattgtagtgttttgactccttattacactgaagaggtcctcttctccttgcgggacctggaaacaccaaatgaagatggtgtttcaatcctcttctacctacaaaagatttttccaggtgatttttgttcatatgctgttaacgtagcctatattcttgaatcacgtcttgaacctgaccttttatctccagatgaatggaacaattttcttgagcgggtgaagtgcttaagtgaagaggaacttaaggagtctgatgaattagaggaggaacttcgtttatgggcttcatatagagggcaaactttgactagaactggtatgcttttttggttaattttctttcagtaaaaagattagatggatacaatggagatatgttgttaatctttgatatttttgcagtaagaggaatgatgtactatcgaaaagccttggagcttcaggcattccttgacatggctatgcatgaaggtgtttttctctagttatattaaacagcaaaggggcataaatcagttcacacaactaatcggtgatgctgactcattcttgcaatttgcttctccagatttgatggaaggttacaaggctgtagaactaaattcagagaacaattcaagaggtgaaagatcactctgggcacagtgccaagctgttgctgacatgaagtttacatatgttgtatcatgtcaacaatatggtatccataaacgatccggtgatcctcgtgcgcaggatatattgaggcttatgacaaggtgtgtagaataataatattttgctgtttgttttaacttgtttgaaacttatgccgttgcttacaattggcagatacccttcactccgtgttgcatatattgatgaggtcgaagaaccagtgaaagacaagtcaaagaaagggaaccagaaagtgtattattctgtgttggtaaaggtgcctaagtcaactgatcattctaccctagcacaaaatctggaccaggtaatgcaaaacaatctaacacttgtctctagctgtagttgctgcaatttattatgtcgttgaatgtgtttgtgtaaagtaaacccgtccagaaggtggtgccaatgctgaatttcttactgtcattttcttagtgaatgctgaataatatatcttataaggattagttaaatggcaacctaatgtcatacacctgtgttaattcataaattgttctgcatctgggaaacatacgtctttttgccgcattagttttatatttactttactgttatatatgctctctcatggtagttttactcctttgttttgattcttacatggatgtctatattaaaatctacatgccttctaggttatctacaggattaggcttcctggacctgctattcttggagaaggaaagccagaaaaccaaaatcatgctatcattttttcccgtggagaaggtttacagacaatcgatatgaatcaggtatgcacttgttctttttgctcagccttctagttatttcgatacttcaagttgatattaagtttcttataatgccatttttattcaggataattacatggaggaagcgttaaagatgaggaatttgcttcaagaatttcttacaaaacatgatggtgttagacatccatccattcttggacttagggaacatatatttactggatcgtgagtgttatagcatttccgtctattttagttattttctcttttgctcaatgaaatttgatcatctctaagaacatttggtgttgggcccttcgcagagtttcatcccttgcttggttcatgtcaaatcaagagactagttttgttaccattggtcagagattattggcaaatccattgaggtaagtgtgttttctgagatcatctgtagtgatgattgcacatgattttgtttgttatcattcccaaatcagaattctctctttctccaatatagggtgcgtttccattatggccatccagatgtttttgatagactgtttcatctaacaagaggtggtgttagcaaagcatccaaggtaatcaacctcagtgaagatatatttgcaggtatattctactcttactgagtagtatctgtttctttcatagactctaactgatgtcctcgctgatggattgccaatgttttgtattgagcaggattcaattctacacttcgtgaaggaaatgttacccatcatgaatacatacaagttggtaaaggaagagatgttggtctaaatcagatctctatgtttgaggccaagattgctaacggcaatggagagcagacattaagtcgggatatttacaggcttggacaccgttttgactttttccgaatgatgtcatgttacttcaccactgttggcttttatttcagcaccctggtattatttcgttccttttttgttaagccaagtaagtaccacacagctatttcggatctgattcattttctactgttttcacagattactgttctcactgtctacatcttcctttatggacgtctctatcttgttttgagtgggctcgaacaaggtttaagtacgcagaaaggcatccgagacaatacacctttgcaaatagctctggcttcacagtcttttgtccagattggtttcctgatggctttacctatgcttatggaaattggattagagaggggttttaggactgccttgagtgaatttgtgctgatgcagcttcagttggcgccagtgttctttacgttctctcttgggacaaagactcactactatgggaggacgttacttcatggcggtgccaagtacaggtccacaggaagaggatttgtcgtctttcatgccaaatttgctgataattacagactgtattcccggagccattttgtgaagggacttgaaatgatgctgctactcgttgtgtatcaaatatttggtagtgcttacagaggcgtccttgcatatcttttgatcaccatatctatgtggttcatggtcgggacctggctttttgctcccttcctcttcaatccttctggttttgaatggcagaagattgttgatgattggactgattggaataaatggataaacaacatcgggggtattggtgttccggcagaaaaaagttgggaatcgtggtgggaggaagagcaagaacatctccggtattccggaaaacgtggtatagttgttgagattttgctagcactgcggttctttatctatcaatatgggcttgtttatcatctcactataacagagaagactaaaaactttctggtatgtaacatttctattagctcttgatgttggtattttcttatccaatcactaaatctaaaatcccttgtcaactcaggtttatggagtatcatggctggtgattttcttgatattgtttgtgatgaaggtgggtttacttgatacatcaatctctttttaattccccagaacgtcatggtcaataaccaagttttttgttgtttgtttgtctcagactgtttcggttggaaggcggagattcagcgcgagttttcagctgatgttccggttgataaaggggctgatattcatgacgtttatcgcaattattgtgatattgatcacactggctcacatgacgatacaagacataattgtgtgtatccttgcctttatgcccacaggttgggggatgctcttggtaagtaaaaaaaaaagcttttcactggagtcctattaaaatggaaatgttgtgcgtgtgtggataaaaacaagactaacacttggtgtgtgtttgcagattgcgcaagcgtgtaagccggtggttcatagagcaggattctggggatcagtgaggaccctagctcgtggatacgagatagtaatgggactgttgctgttcacgccagtggcgttcttggcatggtttccatttgtgtcagagttccaaacgcgtatgctctttaatcaagctttcagtagaggtcttcagatctctcgtatccttggaggtcatcgtaaggatcgctcttctcgaaacaaggaatga

SEQ ID NO: 57 - DNA, 20583 bp, Artificial Sequence
  misc_feature (5333)..(5333): n can be a, g, c or t; /note="complete vector sequence"
tcggagccgcgagctgccgcccgacaacctacccctagcggacttagcggggtagtaggtcggtctttcactccctcggtgccaactactctcgaaacaacatccacccgctcgacggcgggctgttggatggggatcgcctgaatcgccccatcatccagccagaaagtgagggagccacggttgatgagagctttgttgtaggtggtggtcaaccactaaaacttgaaaacgaaacggtgccttgccagacgcaacagcccttctacgcactagactaggaagttgagtcgttttcaagctaaataaccagttggtgattttgaacttttgctttgccacggaacggtctgcgttgtcgggaagatgcgtgatctgatccttcaactcagcaaaagttcgatttatagttgtttcggtgcaacacagagttttagagactacaatgtaacgtgttctatttttatatagtagtacttgttattttgacagacgaatgtatttgtcatcaacaaagccacgttgtgtctcaaaatctctgatgttacattgcacaagataaaaatatatcatcatgaacaataaaactgtctgcttacataaacagtttatgttccccacaatactcggtataagttgccctttgcagaacgagttccggcgctaatttaaggttgtacctacgactaaatatacccatatttacccaatacaaggggtgttatgagccatattcaacgggaaacgtcttgctcaaggccgcgattaaattccaacatggatgctgatttatatgggtataaatggggagcgctattacagcccgttagtccacgctgttagatggctaacatacccttcgggctacgcggtctcaacaaagactttgtaccgtttccatcgcaacgctcgcgataatgtcgggcaatcaggtgcgacaatctaccgattgtatgggaagcccgatgcgccagagttgtttctgaaacatggcaaaggtagcgttgcgttacaacaatgtctactctaccagtctgatttgaccgactgccttaaatacggagaaggctggtagttcgtaaaataggcatgaggactactacgtacccaatgttgttacagatgagatggtcagactaaactggctgacggaatttatgcctcttccgaccatcaagcattttatccgtactcctgatgatgcatggaatgagtggtgacgctagggtcccttttgtcgtaaggtccataatcttcttataggactaagtccacttttataacaactacgcgaccgtcacaaggacgttactcaccactgcgatcccagggaaaacagcattccaggtattagaagaatatcctgattcaggtgaaaatattgttgatgcgctggcagtgttcctgccggccaacgtaagctaaggacaaacattaacaggaaaattgtcgctagcgcataaagcagagcgagtccgcgttagtgcttacttattgccaaaccaactgccggttgcattcgattcctgtttgtaattgtccttttaacagcgatcgcgtatttcgtctcgctcaggcgcaatcacgaatgaataacggtttggttgaacgctcactaaaactactgctcgcattaccgaccggacaacttgttcagacctttctttacgtatttgaaaacggtaagagtggcctaagtcagcagtgatgcgagtgattttgatgacgagcgtaatggctggcctgttgaacaagtctggaaagaaatgcataaacttttgccattctcaccggattcagtcgtcactgtaccactaaagagtgaactattggaataaaaactgctcccctttaattatccaacataactacaacctgctcagccttagcgtctggctatggtcctagcatggtgatttctcacttgataaccttatttttgacgaggggaaattaataggttgtattgatgttggacgagtcggaatcgcagaccgataccaggatcaacggtaggataccttgacggagccactcaaaagaggaagtaatgtctttgccgaaaaagtttttataccataactattaggactatacttatttaacgtttgccatcctatggaactgcctcggtgagttttctccttcattacagaaacggctttttcaaaaatatggtattgataatcctgatatgaataaattgcacaaagtaaactacgagctactcaaaaagattagtgatctggttacaatgtgtatatatgaaatctaactaaattttgaagtaaaaattaaattttcctaggtttcatttgatgctcgatgagtttttctaatcactagaccaatgttacacatatatactttagattgatttaaaacttcatttttaatttaaaaggatcatccacttctaggaaaaactattagagtactggttttagggaattgcactcaaaagcaaggtgactcgcagtctggggcatcttttctagtttcctagaataggtgaagatcctttttgataatctcatgaccaaaatcccttaacgtgagttttcgttccactgagcgtcagaccccgtagaaaagatcaaaggatcttgaactctaggaaaaaaagacgcgcattagacgacgaacgtttgtttttttggtggcgatggtcgccaccaaacaaacggcctagttctcgatggttgagacttgagatcctttttttctgcgcgtaatctgctgcttgcaaacaaaaaaaccaccgctaccagcggtggtttgtttgccggatcaagagctaccaactctagaaggcttccattgaccgaagtcgtctcgcgtctatggtttatgacaagaagatcacatcggcatcaatccggtggtgaagttcttgagacatcgtggctcttccgaaggtaactggcttcagcagagcgcagataccaaatactgttcttctagtgtagccgtagttaggccaccacttcaagaactctgtagcaccgggatgtatggagcgagacgattaggacaatggtcaccgacgacggtcaccgctattcagcacagaatggcccaacctgagttctgctatcaatggcctatcctacatacctcgctctgctaatcctgttaccagtggctgctgccagtggcgataagtcgtgtcttaccgggttggactcaagacgatagttaccggatatccgcgtcgccagcccgacttgccccccaagcacgtgtgtcgggtcgaacctcgcttgctggatgtggcttgactctatggatgtcgcactcgatactctaggcgcagcggtcgggctgaacggggggttcgtgcacacagcccagcttggagcgaacgacctacaccgaactgagatacctacagcgtgagctatgagattcgcggtgcgaagggcttccctctttccgcctgtccataggccattcgccgtcccagccttgtcctctcgcgtgctccctcgaaggtccccctttgcggaagcgccacgcttcccgaagggagaaaggcggacaggtatccggtaagcggcagggtcggaacaggagagcgcacgagggagcttccagggggaaacgccaccatagaaatatcaggacagcccaaagcggtggagactgaactcgcagctaaaaacactacgagcagtccccccgcctcggatacctttttgcggtcgttggtatctttatagtcctgtcgggtttcgccacctctgacttgagcgtcgatttttgtgatgctcgtcaggggggcggagcctatggaaaaacgccagcatgcgccggaaaaatgccaaggaccggaaaacgaccggaaaacgagtgtactctagacgcggcctttttacggttcctggccttttgctggccttttgctcacatgagatcagattaaggcccctagcctttaggtcttcgggctcttctaattccggggatcggaaatccagaagcccgagaccaacggcggaaagcccgaaaaagaaaaagtttttttttttaaatattttgctagacaacgccggccggcggcccaacacccgtttccgcgaccgcgagcggttgccgcctttcgggctttttctttttcaaaaaaaaaaatttataaaacgatctgttgcggccggccgccgggttgtgggcaaaggcgctggcgctcgtgccacccgttggcgaacgccaacaggtgcccgcctcggccacgcgcatcgcgtaacaggtgttcggttcccgctggttattaactatatatataagtatacggtgggcaaccgcttgcggttgtccacgggcggagccggtgcgcgtagcgcattgtccacaagccaagggcgaccaataattgatatatatattcatataacttttcgattaacttgtatgatgaacgacattgatgaacggcctcgctccccacaaacgttcgacaactagactttcccgataatcgcaagagtgcaattgaaaagctaattgaacatactacttgctgtaactacttgccggagcgaggggtgtttgcaagctgttgatctgaaagggctattagcgttctcacgtcggaaaaactaatcgctaaagtgcactggaataatcgctaaagtgcatgaggctaatcgctaaagtgcatgggactaatcgctaaagtgcacctatcaaagcctttttgattagcgatttcacgtgaccttattagcgatttcacgtactccgattagcgatttcacgtaccctgattagcgatttcacgtggatagtttaacctcgcccggcctttcggggcacttagttccgaaacgccccgtaatcgccaaagtgcacctattgatgggagataggtgtccgaaggcccctatttttttggagcgggccggaaagccccgtgaatcaaggctttgcggggcattagcggtttcacgtggataactaccctctatccacaggcttccggggataaaaaagatctcaaacaaacacatacagcgacttagtttacccgccaatatatcctgtcaaggccttcatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgncttccggctcgtatgttgtgtggaattgtgagcggataacaatttcacacaggaaacagctatgaccatgattacgccaagctcggaattaaccctcactaaagggaacaaaagctggagctccaccgcggtggcggccgcgcttcgtccttcgttccttatcggcgagacaacgactccggcgaggatagattactttccctagtttattagggctttggttccttcaactcctcttgagtgattgattccaggtgcttttttctgaattatccaatttcaacaacgtgaaacaccttctttggatcaacctttgatatctcctcagagagagagatatctggaagctgagaaagttagcaacacgatcggaacaaaggatcaccgccggttaggttacacacgctttaacgcgattcagtatgtgcgtgggattattttttataagttttgaatcagaaaaaaagttttacatatgggccgatttattttacatatgggccttttagcattaacgcattgttatgttttttacgccgacgtatgcttttttgtttgggctcaacataactttattgataaagagtatgaccggcctatgtatgaggctgctacttatcgacagcaacatgacttgagtgaaagtgaaagtgaaagtgatgctatcggagttgttgttgttgttcaggactaggactggtatatctttgataaatggttggccagcaggccatgcttgcacttgcatcaaagcttgaataacatctttggtatcctgactcataaattacatgtttaaagcccatgtttaggataaaaacttacatcaaattaaacacttgaaacatataatttggaataagatctaacgaaaacttattggttataaaacaatcaaaggttattagttatctaattactttaaacactgcgccaaatcctctaatcttgttggacaaacgcaacggtaaaaacaacgtcaaacaaaacggtaaaaaaatattgaaaaaagtaatgacgagtcatatgaggtcaaagaagccattcaagtttttaaaaaaccgctaacactttttttattggaatcttcgacttttttgaaattccaaatccccttacaaaaataccctttcggttcataagtattacgttatttgtctcagtgaatagattggaggtacctttttttgcttgctccaagacaaaaccgacattgccacagtttaaacttggtggtgttactgtaattaaatggaaggtagagcctttttctggacacgaccttcgaaagtgtcctttttaaaatttctttttatttttgtgtctattaaagcggtgcttaaaaaaggaagataaatacaaaaaaacattcatttcagactgctctctctctctccctttcactttgcgtacttagcagctaagtagcttaaaaagttgtggctcctttgctccgccattgttagggtttctggatctccgtttctctgtatgttcttctcaatgttgcatctctgttcgtcactgttgatttttaaccatcttcgtctaatgacttttgtttgttttcagggaggctgaggaaaccttaaaacgatttaaaacctggaggttatagggtagacaaaatgtctgctacgagaggaggtcctgatcaagggccgtctcagcctcagcagcggcggattatacgaactcagactgctggtaatcttggagagtcattcgatagtgaagttgttccatcatctcttgttgagattgcccccattcttcgggttgctaatgaagttgaatctagtaatcctagggttgcgtatctctgtaagttcttctaaaacttatttcttaatttggttctctgtcatttggttgtttatctggtttttggttctgctttctcccttaggtcggttttatgcatttgagaaagcacatagattggatcctacctccagtggaaaaggtgttcggcagtttaagactgcacttctacagcgtcttgaaagagtgagcattctttatactctgcttgattcttgcatgtggcagatttggatagctattagaaggaatcttggttttagtacttttctttgacaaatgtggtctactgttgctttgatttttttgcaggaacatgatccaacactgatgggcagggttaagaaaagtgatgcccgtgaaatgcaaagcttttatcaacactactataagaagtatattcaagctttgcacaatgctgctgataaggctgaccggtatgtctaacttacttaaattgtctttttaagatgctaatttgtgttttgccagtgtttgagagcactaaattctcttaatgatactttgaagtgctgttaattttcagtgcccagctgacaaaggcataccaaactgccaatgttttgtttgaggtgttgaaggctgttaatctgacacagtccattgaggttgaccgggaggtaaggcattgtgaccttctagtcctgtctcttttttttttccatctcttgtgcaactttacaatgaagttgaatggttccagattctggaagctcaagataaggttgcagaaaagacacagttgtatgtcccctataatatcctacctctcgatcctgatagtgccaatcaagcgattatgagatatcctgaggttagtcctcttcttgttgggcattgttattatttgtaatatgttatcagcgggtgatgtaatccttactgcagatccaagctgctgttcttgctctccgcaatactagaggtcttccttggccagaaggtcacaagaaaaagaaagatgaagacatgcttgattggcttcaagaaatgtttggatttcaggtaatttttctagttcgtgatgcttgccaattgtcattaagcttttgttgagagtaatctataaattctttaatggtttggcggaaagacaatgcagctaatcttaggagcacttaatcttattacttgctaacatgcaatttttcttgtttatgctatggttctgcagaaagacaatgtggctaatcaaagggagcatctgatcttattacttgctaatgtgcatataagacaatttcctaagcctgatcagcagccaaaggtttataccttaattttaccattgttgaaagaccacttttatataggtttcgtgtgtccatgcatgtaggacatttctgcgcagtacattttttttccatggaatatatatgtaactgcatcctactatgagcataatatttaatgaatgtactttcagtttatcctttcgtttgttctcattgtgccctcacagttagatgatcaagcattgacagaagtgatgaagaagcttttcaagaactataagaaatggtgcaaataccttggtcgaaagagtagtctttggtaagggaattgtagcaacagagagtttctgtatgctgttcatgtacaggaattagatttcgtgtgtgtgtctaaatgtttatgcaaactctggtgtggagaatctgttttaaagtatgatcttcttgtaggttgccaactatacagcaggaaatgcagcagcgcaaactattgtatatggccctgtatcttctaatttggggtgaagcagcgaacttgagattcatgccagagtgtctctgctacatttatcatcatgtaagtttcagtttgtaaggtcttccgtagtttgtgcgtgattcttgtatttttatgcttgtccgccaatgataatcttatgctttactgtcattcttaatccttgaaagttatatcttttgttgtttatatttctgctaaggagctataacttgcacgcacagtaataaaattgtcatctgagtcttgttttgaggcaaaacatgtgtatatgtgctcaggttgacgtatttctgatgagaaaatgtcaattgatattattccccttagaaattagaatgttggttaaatgtcaattgtgctcagggtaccatgctttcttttgataaatacacagattttttgctagtatgcgttcctagatgtgatattcttatacttcctactctatttcatgctttcgcagatggcatttgaactctatggtatgctggctgggaatgttagtcctatgactggggaaaatgtgaagccagcttatggaggcgaggaagatgcattcttgaggaaagttgtgactcctatttatgaagtgattcagatggtaggccttaaatttcgagcttttccttgtgctttcagcagttttttgcttgttaatattcttactcactaattgtgccattcacaggaggctcaaagaagcaaaaaagggaagtctaagcactctcagtggaggaactacgatgatttgaatgaatacttttggtgatatatctatctacctgctttcacacagtcgtaaaggtcttcataagtggtttctacgattaatcaagtatggtttcttcattgcaggtcagttgattgttttcggttaggttggccaatgcgagctgatgctgatttcttttgtctgcctgttgctgtacccaatacagaaaaggacggggtacactataactacacatcttctctgttcttgtctatatattttttttgggtttcgggaatctgctacactgctctagtttctaggtggtgtggttttttttatactaggaactctaatcttttgctactgaattttttttatcatatatcacaggataacagcaagcctattgtcgccagagatagatgggttggtaaagttaattttgttgagattcgttctttctggcatgtcttcagaagtttcgatcgaatgtggagcttctatattctgtgcctccaggtattactatcttctatatgtctctgcctctctctggagctgatgtattaaagaaatgcacattctcataaaatatgatttcgatgatgaattttggaaggccatgattattatggcctgggatggcggacaaccaagttcagtctttggagctgatgtattcaagaaagttctgagcgtgtttatcacagctgcaataatgaaacttggacaaggttggttaatgtaattgttcaatactttcataagtttacttgagtgacgaaagctcatctactagaactatttctgcagctgttcttgatgtgatccttaatttcaaagctcatcaaagcatgacactacatgttaaactaagatacattctgaaagtgttctctgctgctgcctgggttattattctgcctgttacttacgcctacagctggaaagatcctccagcatttgccagaactatcaagagttggtttgggagtgctatgcactcaccttctctatttataatagcagtcgtttcctatttgtcacctaacatgctcgcgggtgtaatgtttcttttccctctgctacgacggtttcttgagaggtccaactacagaattgtaatgctaatgatgtggtggtctcaggttttcatctattcactcagtttgtgttcttgcataagaaactaacgaaaaccttctgttgtgttgtttaactgatgtgactataattaacaccttgcagcccagactctacgttggcagaggaatgcacgagagcgcattttccctcttcaagtaagggttctgtttgtgacataaacatcattggattttagttactggtgcaagcctgagtcctctgttcactcatgtctctctacctttttcttgcgtagatataccatgttctgggtgttgcttattgcaacaaagctggcattcagttactacattgaggtatgtgtttcttgtatctagttctggtaattattaaccatgctgtgagaagagtaagattcgtgatgagacatggaaacaataattatgggattgaattgactgatttttccatgattgccacaactgaagtctgataaattggcattgctcacagatcaggcctttagttgccccaacacaagccattatgaaggcccgtgtgacaaattttcagtggcatgagttctttcctcgtggtaatgcactttcacatacactacatgattgctggaatgaaaatttatcatttattctcacaccatctctacttgatttgtgcagccaaaaacaatattggtgtcgttatcgccctctgggcccccattattctggtaagcatggtcaagtcgaacatgtctgcacgtcctcccctgctttgtgctgttgctaatttgatctcggctacatcttgctgcaggtatattttatggatagtcagatttggtatgctatattttccacattatttggaggtatctacggtgcattccgccgccttggagaggtatgcatttttaagataatctgattgaagctgagttatttgttgaacttgaggtttcccttgtaattgttattgatgttctctaaatccttgcgtttttcacttgttacagattcggacactgggaatgctcagatcacggtttgaatcactgcctggagcttttaatgaccgcttaattccagatggaaagaaccagcaaaagaagaagggaataagggcaacgttatctcataactttacggaggataaggtttgttgaacgagtgaactgctatcacgtacaattcttctcattgattgcttgtactgaaaatttacttcaggtacctgtgaacaaagagaaagaagctgcaagatttgcacagttgtggaacacaataattagtagttttagagaggaagatcttataagtgataggtaattttattaattttctatgccacatatctagctgaaagaaactatctggaactcaaaaaatttgagctatctttttgcatttggactattcatagggagatggatctgttgcttgttccttattgggctgaccgtgatttggatctcatacagtggcctcccttcttattggctagcaaggtttgctctcacagaaacacattagaatttaatcttttggttattctaattttttctatatttggctgtagattccaatagcattagatatggcaaaagacagtaatgggaaggacagagagctcaagaagaggattgagagtgacacttacatgaaatgtgctgtccgtgaatgctatgcttcattcaagaatatcataaaatttgtggttcagggaaaccgtgaaaaagagtaagttgggttaagtttttggaaccatagtgtttgaacttgcttttgtttcttacatatctacttctgattttgataattgcaagtttgcaacgtaccacactatattatggccaatttatatcttcgtgtctcagggtgatagagatcatatttgcagaggttgacaaacatatagatacaggggatttgattcaagaatacaagatgagtgctcttcctagcctctatgatcactttgtcaagttgatcaaatatttggtaaatgttcttcctgtggtactgtttcttttgtagttttagtatctaaaaacttatttgtcaattggtccaatatcttcgttttcttatccaatgtagcttgacaataaggaggaagatagagatcacgttgtaattctcttccaagacatgctggaagttgtaacaagagacattatgatggaggattacaatatatcgaggttggcgactttctaccgcaccgcaatggcttgtcgtatgaacatcaaaatcttatatatctagtgtctctgtagcttggtagattcaagtcatggtggcacttggcatgggggaatgatccctctcgaacaacaatatcagctgtttgcatcctcaggtgccattagatttcctattgaaccagtaacagaagcttggaaagagaaggttatgccagatagggttatatttaagttctattcgcgcagtcttcatatgatttgttctcaaaactttaatgcatgtatgtgtagatcaaacggatatatcttttgttgactactaaagagtctgctatggatgtcccctctaacttggaagcaagaaggcggatctcattcttctcaaattcgttgttcatggacatgcctatggcacctaaagttcgcaacatgctatcattttcgtaagcaatttctggtcattttaattagaatccactacttatatagtcacatattgttggaagattattggttcttctaaaattccagttgataatttcctcaaattcttcttttatgatgacaaaactaagatttagaactgttgtatcatgcaattgctacttgtttataattataatgaagtatgaattgcaatgtagtttttcgtaactgaactggctgggttagtttgtcattataatgttttgcttttattgaagttttcgttacttaactggtggggttttctctttgctattctcattgtagtgttttgactccttattacactgaagaggtcctcttctccttgcgggacctggaaacaccaaatgaagatggtgtttcaatcctcttctacctacaaaagatttttccaggtgatttttgttcatatgctgttaacgtagcctatattcttgaatcacgtcttgaacctgaccttttatctccagatgaatggaacaattttcttgagcgggtgaagtgcttaagtgaagaggaacttaaggagtctgatgaattagaggaggaacttcgtttatgggcttcatatagagggcaaactttgactagaactggtatgcttttttggttaattttctttcagtaaaaagattagatggatacaatggagatatgttgttaatctttgatatttttgcagtaagaggaatgatgtactatcgaaaagccttggagcttcaggcattccttgacatggctatgcatgaaggtgtttttctctagttatattaaacagcaaaggggcataaatcagttcacacaactaatcggtgatgctgactcattcttgcaatttgcttctccagatttgatggaaggttacaaggctgtagaactaaattcagagaacaattcaagaggtgaaagatcactctgggcacagtgccaagctgttgctgacatgaagtttacatatgttgtatcatgtcaacaatatggtatccataaacgatccggtgatcctcgtgcgcaggatatattgaggcttatgacaaggtgtgtagaataataatattttgctgtttgttttaacttgtttgaaacttatgccgttgcttacaattggcagatacccttcactccgtgttgcatatattgatgaggtcgaagaaccagtgaaagacaagtcaaagaaagggaaccagaaagtgtattattctgtgttggtaaaggtgcctaagtcaactgatcattctaccctagcacaaaatctggaccaggtaatgcaaaacaatctaacacttgtctctagctgtagttgctgcaatttattatgtcgttgaatgtgtttgtgtaaagtaaacccgtccagaaggtggtgccaatgctgaatttcttactgtcattttcttagtgaatgctgaataatatatcttataaggattagttaaatggcaacctaatgtcatacacctgtgttaattcataaattgttctgcatctgggaaacatacgtctttttgccgcattagttttatatttactttactgttatatatgctctctcatggtagttttactcctttgttttgattcttacatggatgtctatattaaaatctacatgccttctaggttatctacaggattaggcttcctggacctgctattcttggagaaggaaagccagaaaaccaaaatcatgctatcattttttcccgtggagaaggtttacagacaatcgatatgaatcaggtatgcacttgttctttttgctcagccttctagttatttcgatacttcaagttgatattaagtttcttataatgccatttttattcaggataattacatggaggaagcgttaaagatgaggaatttgcttcaagaatttcttacaaaacatgatggtgttagacatccatccattcttggacttagggaacatatatttactggatcgtgagtgttatagcatttccgtctattttagttattttctcttttgctcaatgaaatttgatcatctctaagaacatttggtgttgggcccttcgcagagtttcatcccttgcttggttcatgtcaaatcaagagactagttttgttaccattggtcagagattattggcaaatccattgaggtaagtgtgttttctgagatcatctgtagtgatgattgcacatgattttgtttgttatcattcccaaatcagaattctctctttctccaatatagggtgcgtttccattatggccatccagatgtttttgatagactgtttcatctaacaagaggtggtgttagcaaagcatccaaggtaatcaacctcagtgaagatatatttgcaggtatattctactcttactgagtagtatctgtttctttcatagactctaactgatgtcctcgctgatggattgccaatgttttgtattgagcaggattcaattctacacttcgtgaaggaaatgttacccatcatgaatacatacaagttggtaaaggaagagatgttggtctaaatcagatctctatgtttgaggccaagattgctaacggcaatggagagcagacattaagtcgggatatttacaggcttggacaccgttttgactttttccgaatgatgtcatgttacttcaccactgttggcttttatttcagcaccctggtattatttcgttccttttttgttaagccaagtaagtaccacacagctatttcggatctgattcattttctactgttttcacagattactgttctcactgtctacatcttcctttatggacgtctctatcttgttttgagtgggctcgaacaaggtttaagtacgcagaaaggcatccgagacaatacacctttgcaaatagctctggcttcacagtcttttgtccagattggtttcctgatggctttacctatgcttatggaaattggattagagaggggttttaggactgccttgagtgaatttgtgctgatgcagcttcagttggcgccagtgttctttacgttctctcttgggacaaagactcactactatgggaggacgttacttcatggcggtgccaagtacaggtccacaggaagaggatttgtcgtctttcatgccaaatttgctgataattacagactgtattcccggagccattttgtgaagggacttgaaatgatgctgctactcgttgtgtatcaaatatttggtagtgcttacagaggcgtccttgcatatcttttgatcaccatatctatgtggttcatggtcgggacctggctttttgctcccttcctcttcaatccttctggttttgaatggcagaagattgttgatgattggactgattggaataaatggataaacaacatcgggggtattggtgttccggcagaaaaaagttgggaatcgtggtgggaggaagagcaagaacatctccggtattccggaaaacgtggtatagttgttgagattttgctagcactgcggttctttatctatcaatatgggcttgtttatcatctcactataacagagaagactaaaaactttctggtatgtaacatttctattagctcttgatgttggtattttcttatccaatcactaaatctaaaatcccttgtcaactcaggtttatggagtatcatggctggtgattttcttgatattgtttgtgatgaaggtgggtttacttgatacatcaatctctttttaattccccagaacgtcatggtcaataaccaagttttttgttgtttgtttgtctcagactgtttcggttggaaggcggagattcagcgcgagttttcagctgatgttccggttgataaaggggctgatattcatgacgtttatcgcaattattgtgatattgatcacactggctcacatgacgatacaagacataattgtgtgtatccttgcctttatgcccacaggttgggggatgctcttggtaagtaaaaaaaaaagcttttcactggagtcctattaaaatggaaatgttgtgcgtgtgtggataaaaacaagactaacacttggtgtgtgtttgcagattgcgcaagcgtgtaagccggtggttcatagagcaggattctggggatcagtgaggaccctagctcgtggatacgagatagtaatgggactgttgctgttcacgccagtggcgttcttggcatggtttccatttgtgtcagagttccaaacgcgtatgctctttaatcaagctttcagtaaaggtcttcagatctctcgtatccttggaggtcatcgtaaggatcgctcttctcgaaacaaggaatgattcatctcttcattgtaatgacagggaagggatcttaatttatcccttttttatcttcatggatgattagggttaatgtaatttagttttcaatatatcgcttaggtaaaaacattgtagtattcatctataaattagacgttatctatcatttaatgactgtttaattatttagttgaagacctccattggtccatgtcgaggaagataaggaacttactaacaacttttgcttggcctataagatacagcgacaacaaagctttcaaaaattccctagttaccaactgggttcattaatgggccgataaggaaagcccacgatcttctaagaaggattagccctagtttcctctgcttcgttgaaagacaacttaaaaaatggcgggaagttgtgacaatgtttggttcgacaaataagcggagacgtggcggcgatacgtggcaccacgacatttgtacgagaatgataatttgtcttggttcgagccagcctgtaaacggtaatctgtgtccgtacagcttaaatctcatcccaaaaagaacaaccaaaatgacggatttggccccaacaaagctgtaaaacgaggttaaaacccggaactttcaccttattagacgacgacacacctctcgtcactcttgtcgagactcttaccacaaagaggtttttgaaatggcggcgatgaaatacaaaggaagcgtttttatcatattagtcatccttcttctttcgtcctcactacttgctcactcttcttcctcgagggggggcccggtacccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcgaaattgtaaacgttaatgttatcgtacccctactccaaaaatgtcaaagatacagtctcagaagaccaaagggctattgagacttttcaacaaagggtaatttcgggaaacctcctcggattccattgcccagctatctgtcacttcatcgaaaggacagtagaaaaggaaggtggctcctacaaatgccatcattgcgataaaggaaaggctatcattcaagatgcctctgccgacagtggtcccaaagatggacccccacccacgaggagcatcgtggaaaaagaagacgttccaaccacgtcttcaaagcaagtggattgatgtgacatctccactgacgtaagggatgacgcacaatcccactatccttcgcaagacccttcctctatataaggaagttcatttcatttggagaggacagcccaagctgatccctatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggagttcagcgagagcctgacctattgcatctcccgccgtgcacagggtgtcacgttgcaagacctgcctgaaaccgaactgcccgctgttcttcagccggtcgcggaggctatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccacgcctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagagtagatgccgaccgaacaagagctgatttcgagaacgcctcagccagcaactcgcgcgagcctagcaaggcaaatgcgagagaacggccttacgcttggtggcacagttctcgtccacagttcgctaagctcgctcggctggtcgcgggagaattaattcggtacgctgaaatcaccagtctctctctacaaatctatctctctctattttctccataaataatgtgtgagtagtttcccgataagggaaattagggttcttatagggtttcgctcatgtgttgagcatataagaaacccttagtatgtatttgtatttgtaaaatacttctatcaataaaatttctaattcctaaaaccaaaatccagtactaaaatccagatcgataacgttacaccacaatatatcctgccaagatct

SEQ ID NO: 58 - DNA, 11760 bp, Artificial Sequence
  Plasmid
gtacaaaaaagcaggctcaatgtctgctacgagaggaggtcctgatcaagggccgtctcagcctcagcagcggcggattatacgaactcagactgctggtaatcttggagagtcattcgatagtgaagttgttccatcatctcttgttgagattgcccccattcttcgggttgctaatgaagttgaatctagtaatcctagggttgcgtatctctgtcggttttatgcatttgagaaagcacatagattggatcctacctccagtggaaaaggtgttcggcagtttaagactgcacttctacagcgtcttgaaagagtgagcattctttatactctgcttgattcttgcatgtggcagatttggatagctattagaaggaatcttggttttagtacttttctttgacaaatgtggtctactgttgctttgatttttttgcaggaacatgatccaacactgatgggcagggttaagaaaagtgatgcccgtgaaatgcaaagcttttatcaacactactataagaagtatattcaagctttgcacaatgctgctgataaggctgaccggtatgtctaacttacttaaattgtctttttaagatgctaatttgtgttttgccagtgtttgagagcactaaattctcttaatgatactttgaagtgctgttaattttcagtgcccagctgacaaaggcataccaaactgccaatgttttgtttgaggtgttgaaggctgttaatctgacacagtccattgaggttgaccgggaggtaaggcattgtgaccttctagtcctgtctcttttttttttccatctcttgtgcaactttacaatgaagttgaatggttccagattctggaagctcaagataaggttgcagaaaagacacagttgtatgtcccctataatatcctacctctcgatcctgatagtgccaatcaagcgattatgagatatcctgaggttagtcctcttcttgttgggcattgttattatttgtaatatgttatcagcgggtgatgtaatccttactgcagatccaagctgctgttcttgctctccgcaatactagaggtcttccttggccagaaggtcacaagaaaaagaaagatgaagacatgcttgattggcttcaagaaatgtttggatttcaggtaatttttctagttcgtgatgcttgccaattgtcattaagcttttgttgagagtaatctataaattctttaatggtttggcggaaagacaatgcagctaatcttaggagcacttaatcttattacttgctaacatgcaatttttcttgtttatgctatggttctgcagaaagacaatgtggctaatcaaagggagcatctgatcttattacttgctaatgtgcatataagacaatttcctaagcctgatcagcagccaaaggtttataccttaattttaccattgttgaaagaccacttttatataggtttcgtgtgtccatgcatgtaggacatttctgcgcagtacattttttttccatggaatatatatgtaactgcatcctactatgagcataatatttaatgaatgtactttcagtttatcctttcgtttgttctcattgtgccctcacagttagatgatcaagcattgacagaagtgatgaagaagcttttcaagaactataagaaatggtgcaaataccttggtcgaaagagtagtctttggtaagggaattgtagcaacagagagtttctgtatgctgttcatgtacaggaattagatttcgtgtgtgtgtctaaatgtttatgcaaactctggtgtggagaatctgttttaaagtatgatcttcttgtaggttgccaactatacagcaggaaatgcagcagcgcaaactattgtatatggccctgtatcttctaatttggggtgaagcagcgaacttgagattcatgccagagtgtctctgctacatttatcatcatgtaagtttcagtttgtaaggtcttccgtagtttgtgcgtgattcttgtatttttatgcttgtccgccaatgataatcttatgctttactgtcattcttaatccttgaaagttatatcttttgttgtttatatttctgctaaggagctataacttgcacgcacagtaataaaattgtcatctgagtcttgttttgaggcaaaacatgtgtatatgtgctcaggttgacgtatttctgatgagaaaatgtcaattgatattattccccttagaaattagaatgttggttaaatgtcaattgtgctcagggtaccatgctttcttttgataaatacacagattttttgctagtatgcgttcctagatgtgatattcttatacttcctactctatttcatgctttcgcagatggcatttgaactctatggtatgctggctgggaatgttagtcctatgactggggaaaatgtgaagccagcttatggaggcgaggaagatgcattcttgaggaaagttgtgactcctatttatgaagtgattcagatggtaggccttaaatttcgagcttttccttgtgctttcagcagttttttgcttgttaatattcttactcactaattgtgccattcacaggaggctcaaagaagcaaaaaagggaagtctaagcactctcagtggaggaactacgatgatttgaatgaatacttttggtgatatatctatctacctgctttcacacagtcgtaaaggtcttcataagtggtttctacgattaatcaagtatggtttcttcattgcaggtcagttgattgttttcggttaggttggccaatgcgagctgatgctgatttcttttgtctgcctgttgctgtacccaatacagaaaaggacggggtacactataactacacatcttctctgttcttgtctatatattttttttgggtttcgggaatctgctacactgctctagtttctaggtggtgtggttttttttatactaggaactctaatcttttgctactgaattttttttatcatatatcacaggataacagcaagcctattgtcgccagagatagatgggttggtaaagttaattttgttgagattcgttctttctggcatgtcttcagaagtttcgatcgaatgtggagcttctatattctgtgcctccaggtattactatcttctatatgtctctgcctctctctggagctgatgtattaaagaaatgcacattctcataaaatatgatttcgatgatgaattttggaaggccatgattattatggcctgggatggcggacaaccaagttcagtctttggagctgatgtattcaagaaagttctgagcgtgtttatcacagctgcaataatgaaacttggacaaggttggttaatgtaattgttcaatactttcataagtttacttgagtgacgaaagctcatctactagaactatttctgcagctgttcttgatgtgatccttaatttcaaagctcatcaaagcatgacactacatgttaaactaagatacattctgaaagtgttctctgctgctgcctgggttattattctgcctgttacttacgcctacagctggaaagatcctccagcatttgccagaactatcaagagttggtttgggagtgctatgcactcaccttctctatttataatagcagtcgtttcctatttgtcacctaacatgctcgcgggtgtaatgtttcttttccctctgctacgacggtttcttgagaggtccaactacagaattgtaatgctaatgatgtggtggtctcaggttttcatctattcactcagtttgtgttcttgcataagaaactaacgaaaaccttctgttgtgttgtttaactgatgtgactataattaacaccttgcagcccagactctacgttggcagaggaatgcacgagagcgcattttccctcttcaagtaagggttctgtttgtgacataaacatcattggattttagttactggtgcaagcctgagtcctctgttcactcatgtctctctacctttttcttgcgtagatataccatgttctgggtgttgcttattgcaacaaagctggcattcagttactacattgaggtatgtgtttcttgtatctagttctggtaattattaaccatgctgtgagaagagtaagattcgtgatgagacatggaaacaataattatgggattgaattgactgatttttccatgattgccacaactgaagtctgataaattggcattgctcacagatcaggcctttagttgccccaacacaagccattatgaaggcccgtgtgacaaattttcagtggcatgagttctttcctcgtggtaatgcactttcacatacactacatgattgctggaatgaaaatttatcatttattctcacaccatctctacttgatttgtgcagccaaaaacaatattggtgtcgttatcgccctctgggcccccattattctggtaagcatggtcaagtcgaacatgtctgcacgtcctcccctgctttgtgctgttgctaatttgatctcggctacatcttgctgcaggtatattttatggatagtcagatttggtatgctatattttccacattatttggaggtatctacggtgcattccgccgccttggagaggtatgcatttttaagataatctgattgaagctgagttatttgttgaacttgaggtttcccttgtaattgttattgatgttctctaaatccttgcgtttttcacttgttacagattcggacactgggaatgctcagatcacggtttgaatcactgcctggagcttttaatgaccgcttaattccagatggaaagaaccagcaaaagaagaagggaataagggcaacgttatctcataactttacggaggataaggtttgttgaacgagtgaactgctatcacgtacaattcttctcattgattgcttgtactgaaaatttacttcaggtacctgtgaacaaagagaaagaagctgcaagatttgcacagttgtggaacacaataattagtagttttagagaggaagatcttataagtgataggtaattttattaattttctatgccacatatctagctgaaagaaactatctggaactcaaaaaatttgagctatctttttgcatttggactattcatagggagatggatctgttgcttgttccttattgggctgaccgtgatttggatctcatacagtggcctcccttcttattggctagcaaggtttgctctcacagaaacacattagaatttaatcttttggttattctaattttttctatatttggctgtagattccaatagcattagatatggcaaaagacagtaatgggaaggacagagagctcaagaagaggattgagagtgacacttacatgaaatgtgctgtccgtgaatgctatgcttcattcaagaatatcataaaatttgtggttcagggaaaccgtgaaaaagaggtgatagagatcatatttgcagaggttgacaaacatatagatacaggggatttgattcaagaatacaagatgagtgctcttcctagcctctatgatcactttgtcaagttgatcaaatatttgcttgacaataaggaggaagatagagatcacgttgtaattctcttccaagacatgctggaagttgtaacaagagacattatgatggaggattacaatatatcgaggttggattcaagtcatggtggcacttggcatgggggaatgatccctctcgaacaacaatatcagctgtttgcatcctcaggtgccattagatttcctattgaaccagtaacagaagcttggaaagagaagatcaaacggatatatcttttgttgactactaaagagtctgctatggatgtcccctctaacttggaagcaagaaggcggatctcattcttctcaaattcgttgttcatggacatgcctatggcacctaaagttcgcaacatgctatcattttctgttttgactccttattacactgaagaggtcctcttctccttgcgggacctggaaacaccaaatgaagatggtgtttcaatcctcttctacctacaaaagatttttccagatgaatggaacaattttcttgagcgggtgaagtgcttaagtgaagaggaacttaaggagtctgatgaattagaggaggaacttcgtttatgggcttcatatagagggcaaactttgactagaactgtaagaggaatgatgtactatcgaaaagccttggagcttcaggcattccttgacatggctatgcatgaagatttgatggaaggttacaaggctgtagaactaaattcagagaacaattcaagaggtgaaagatcactctgggcacagtgccaagctgttgctgacatgaagtttacatatgttgtatcatgtcaacaatatggtatccataaacgatccggtgatcctcgtgcgcaggatatattgaggcttatgacaagatacccttcactccgtgttgcatatattgatgaggtcgaagaaccagtgaaagacaagtcaaagaaagggaaccagaaagtgtattattctgtgttggtaaaggtgcctaagtcaactgatcattctaccctagcacaaaatctggaccaggttatctacaggattaggcttcctggacctgctattcttggagaaggaaagccagaaaaccaaaatcatgctatcattttttcccgtggagaaggtttacagacaatcgatatgaatcaggataattacatggaggaagcgttaaagatgaggaatttgcttcaagaatttcttacaaaacatgatggtgttagacatccatccattcttggacttagggaacatatatttactggatcagtttcatcccttgcttggttcatgtcaaatcaagagactagttttgttaccattggtcagagattattggcaaatccattgaggtaagtgtgttttctgagatcatctgtagtgatgattgcacatgattttgtttgttatcattcccaaatcagaattctctctttctccaatatagggtgcgtttccattatggccatccagatgtttttgatagactgtttcatctaacaagaggtggtgttagcaaagcatccaaggtaatcaacctcagtgaagatatatttgcaggtatattctactcttactgagtagtatctgtttctttcatagactctaactgatgtcctcgctgatggattgccaatgttttgtattgagcaggattcaattctacacttcgtgaaggaaatgttacccatcatgaatacatacaagttggtaaaggaagagatgttggtctaaatcagatctctatgtttgaggccaagattgctaacggcaatggagagcagacattaagtcgggatatttacaggcttggacaccgttttgactttttccgaatgatgtcatgttacttcaccactgttggcttttatttcagcaccctggtattatttcgttccttttttgttaagccaagtaagtaccacacagctatttcggatctgattcattttctactgttttcacagattactgttctcactgtctacatcttcctttatggacgtctctatcttgttttgagtgggctcgaacaaggtttaagtacgcagaaaggcatccgagacaatacacctttgcaaatagctctggcttcacagtcttttgtccagattggtttcctgatggctttacctatgcttatggaaattggattagagaggggttttaggactgccttgagtgaatttgtgctgatgcagcttcagttggcgccagtgttctttacgttctctcttgggacaaagactcactactatgggaggacgttacttcatggcggtgccaagtacaggtccacaggaagaggatttgtcgtctttcatgccaaatttgctgataattacagactgtattcccggagccattttgtgaagggacttgaaatgatgctgctactcgttgtgtatcaaatatttggtagtgcttacagaggcgtccttgcatatcttttgatcaccatatctatgtggttcatggtcgggacctggctttttgctcccttcctcttcaatccttctggttttgaatggcagaagattgttgatgattggactgattggaataaatggataaacaacatcgggggtattggtgttccggcagaaaaaagttgggaatcgtggtgggaggaagagcaagaacatctccggtattccggaaaacgtggtatagttgttgagattttgctagcactgcggttctttatctatcaatatgggcttgtttatcatctcactataacagagaagactaaaaactttctggtatgtaacatttctattagctcttgatgttggtattttcttatccaatcactaaatctaaaatcccttgtcaactcaggtttatggagtatcatggctggtgattttcttgatattgtttgtgatgaaggtgggtttacttgatacatcaatctctttttaattccccagaacgtcatggtcaataaccaagttttttgttgtttgtttgtctcagactgtttcggttggaaggcggagattcagcgcgagttttcagctgatgttccggttgataaaggggctgatattcatgacgtttatcgcaattattgtgatattgatcacactggctcacatgacgatacaagacataattgtgtgtatccttgcctttatgcccacaggttgggggatgctcttggtaagtaaaaaaaaaagcttttcactggagtcctattaaaatggaaatgttgtgcgtgtgtggataaaaacaagactaacacttggtgtgtgtttgcagattgcgcaagcgtgtaagccggtggttcatagagcaggattctggggatcagtgaggaccctagctcgtggatacgagatagtaatgggactgttgctgttcacgccagtggcgttcttggcatggtttccatttgtgtcagagttccaaacgcgtatgctctttaatcaagctttcagtaaaggtcttcagatctctcgtatccttggaggtcatcgtaaggatcgctcttctcgaaacaaggaatgattcatctcttcattgtaatgacagggaagggatcttaatttatcccttttttatcttcatggatgattagggttaatgtaatttagttttcaatatatcgcttaggtaaaaacattgtagtaaacccagctttcttgtacaaagttggcattataagaaagcattgcttatcaatttgttgcaacgaacaggtcactatcagtcaaaataaaatcattatttgccatccagctgatatcccctatagtgagtcgtattacatggtcatagctgtttcctggcagctctggcccgtgtctcaaaatctctgatgttacattgcacaagataaaataatatcatcatgaacaataaaactgtctgcttacataaacagtaatacaaggggtgttatgagccatattcaacgggaaacgtcgaggccgcgattaaattccaacatggatgctgatttatatgggtataaatgggctcgcgataatgtcgggcaatcaggtgcgacaatctatcgcttgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccggaaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaatcagaattggttaattggttgtaacactggcagagcattacgctgacttgacgggacggcgcaagctcatgaccaaaatcccttaacgtgagttacgcgtcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgttcttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatacgcgtaccgctagccaggaagagtttgtagaaacgcaaaaaggccatccgtcaggatggccttctgcttagtttgatgcctggcagtttatggcgggcgtcctgcccgccaccctccgggccgttgcttcacaacgttcaaatccgctcccggcggatttgtcctactcaggagagcgttcaccgacaaacaacagataaaacgaaaggcccagtcttccgactgagcctttcgttttatttgatgcctggcagttccctactctcgcgttaacgctagcatggatgttttcccagtcacgacgttgtaaaacgacggccagtcttaagctcgggccccaaataatgattttattttgactgatagtgacctgttcgttgcaacaaattgatgagcaatgcttttttataatgccaacttt

SEQ ID NO: 59 - DNA, 33 bp, Artificial Sequence
  Primer for cloning 3.1 kb genomic fragment
aatatgcggccgcgcttcgtccttcgttcctta

SEQ ID NO: 60 - DNA, 36 bp, Artificial Sequence
  Primer for cloning 3.1 kb genomic fragment
aatatctcgagtgcagttacatatatattccatgga

SEQ ID NO: 61 - DNA, 30 bp, Artificial Sequence
  Primer for cloning 5.3 kb genomic fragment
aatattccatggaatatatatgtaactgca

SEQ ID NO: 62 - DNA, 35 bp, Artificial Sequence
  Primer for cloning 5.3 kb genomic fragment
aatatctcgagggctacgttaacagcatatgaaca

SEQ ID NO: 63 - DNA, 22 bp, Artificial Sequence
  Primer for cloning 4.7 kb genomic fragment
tgttcatatgctgttaacgtag

SEQ ID NO: 64 - DNA, 36 bp, Artificial Sequence
  Primer for cloning 4.7 kb genomic fragment
ttaatctcgaggaagaagagtgagcaagtagtgagg

SEQ ID NO: 65 - DNA, 40 bp, Artificial Sequence
  Primer for introducing cals3-1d mutation
cttaaactgccgaacaccttttccactggaggtaggatcc

SEQ ID NO: 66 - DNA, 40 bp, Artificial Sequence
  Primer for introducing cals3-1d mutation
ggatcctacctccagtggaaaaggtgttcggcagtttaag

SEQ ID NO: 67 - DNA, 37 bp, Artificial Sequence
  Primer for introducing the cals3-2d mutation
ggatacgagagatctgaagacctttactgaaagcttg

SEQ ID NO: 68 - DNA, 37 bp, Artificial Sequence
  Primer for introducing the cals3-2d mutation
caagctttcagtaaaggtcttcagatctctcgtatcc

SEQ ID NO: 69 - DNA, 36 bp, Artificial Sequence
  Primer for cloning pEN-cals3m
aaaaagcaggctcaatgtctgctacgagaggaggtc

SEQ ID NO: 70 - DNA, 40 bp, Artificial Sequence
  Primer for cloning pEN-cals3m
agaaagctgggtttactacaatgtttttacctaagcgata

SEQ ID NO: 71 - DNA, 22 bp, Artificial Sequence
  Primer for cloning pEN-cals3m
caaaatgtctgctacgagagga

SEQ ID NO: 72 - DNA, 20 bp, Artificial Sequence
  Primer for cloning pEN-cals3m
ggtagaaagtcgccaacctc

SEQ ID NO: 73 - DNA, 33 bp, Artificial Sequence
  Primer for cloning pEN-cals3m
aatatccatggcaaaatgtctgctacgagagga

SEQ ID NO: 74 - DNA, 33 bp, Artificial Sequence
  Primer for cloning pEN-cals3m
aatatgcggccgctgagatccaaatcacggtca

SEQ ID NO: 75 - DNA, 23 bp, Artificial Sequence
  Primer for cloning pEN-cals3m
tacggaggataaggtacctgtga

SEQ ID NO: 76 - DNA, 35 bp, Artificial Sequence
  Primer for cloning pEN-cals3m
aatatgcggccgctgccaataatctctgaccaatg

SEQ ID NO: 77 - DNA, 20 bp, Artificial Sequence
  Primer for cloning pEN-cals3m
tttcatcccttgcttggttc

SEQ ID NO: 78 - DNA, 40 bp, Artificial Sequence
  Primer for cloning pEN-cals3m
aatatgcggccgctactacaatgtttttacctaagcgata

The invention claimed is:

1. A polypeptide comprising a sequence that is at least 95% identical to a sequence selected from the group consisting of:
    (a) SEQ ID NO:49, provided that amino acid 84 is lysine;
    (b) SEQ ID NO:50, provided that amino acid 1926 is lysine;
    (c) SEQ ID NO:51, provided that amino acid 189 is leucine;
    (d) SEQ ID NO:52, provided that amino acid 84 is lysine and amino acid 1926 is lysine;
    (e) SEQ ID NO:53, provided that amino acid 84 is lysine and amino acid 189 is leucine;
    (f) SEQ ID NO:54, provided that amino acid 1926 is lysine and amino acid 189 is leucine; and
    (g) SEQ ID NO:55, provided that amino acid 84 is lysine, amino acid 1926 is lysine, and amino acid 189 is leucine.

2. The polypeptide according to claim 1 comprising a sequence selected from the group consisting of SEQ ID NOS: 49-55.

3. A polynucleotide encoding the polypeptide according to claim 2.

4. An expression cassette comprising the polynucleotide according to claim 3.

5. The expression cassette according to claim 4 comprising a tissue-specific or an inducible promoter operably linked to said polynucleotide.

6. A vector comprising the polynucleotide according to claim 3 or the expression cassette according to claim 4.

7. A host cell comprising the polynucleotide according to claim 3, the expression cassette according to claim 4, the expression cassette according to claim 5, or the vector according to claim 6.

8. The host cell according to claim 7, wherein said cell is a prokaryotic cell.

9. A host cell according to claim 7, wherein said cell is a plant cell.

10. A plant comprising the polynucleotide according to claim 3 or the expression cassette according to claim 4.

11. A transgenic plant stably transformed with the vector of claim 6.

12. A method for modifying the composition of a plant cell wall, comprising introducing into a cell of the plant the expression cassette according to claim 3, whereby callose biosynthesis and/or accumulation in the plant cell wall is increased relative to a control plant cell that does not comprise the expression cassette.

13. A method for regulating closure of plasmodesmata, comprising introducing into cells of a plant the expression cassette according to claim 3, whereby plasmodesmata of the plant are closed relative to a control plant cell that does not comprise the expression cassette.

14. A method for producing a plant resistant to pathogens, comprising introducing into cells of a plant the expression cassette according to claim 3, whereby the plant is more resistant to pathogens than a control plant that does not contain the expression cassette.

15. A method for modifying wood formation and/or wood composition, comprising introducing into cells of a plant the expression cassette according to claim 3, whereby wood formation by the plant and/or the composition of wood formed by the plant is modified relative to a control plant that does not contain the expression cassette.

* * * * *